United States Patent 9,115,368 (GENES AND USES FOR PLANT IMPROVEMENT) - sequence listing, part 2

SEQ ID NO: 3892 - protein, 337 aa, Oryza sativa
  unsure (1)..(337): unsure at all Xaa locations
MAKASAAAPDATSTAHPPRPALHDITNDSPIVGLASSGLRTPASTAAKARPTRASRRTPGSGEALLRGQVKTLLQKVHHDASSSSSCAAAAPPSPNILRIHAPIGLARSPAHLLAPTPANTPHLTAAAPHAFTMTVPCVLEEELLSKLQVIADALPPPPAQAEENHLGECNRALVFDDSPGKSDLSNAASVLWSSSLSFQDSSSTDXSPDDDSSSXWSIQVNASSEKGDEDTFTDQDPEEEEEEWLTEDDDDDECFDDLCEGMSKMSVFDDEEEEDKKAGLPAFQGKHTRFIYDSDGEMEREDVAHVPVENCTMVLRGLPVPEGKHLRFHEVEEDEE

SEQ ID NO: 3893 - protein, 594 aa, Zea mays
MLYSTQTMLQTMDIVRFKISSLHIYTNLFNFYFLLNIKHKKTHGELGDLTTNRRSPLLLAIVEGERERERPRSVGFGFGRQLQLSATATMGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 3894 - protein, 775 aa, Glycine max
  unsure (1)..(775): unsure at all Xaa locations
MQQGDPTVLSLRPGGGRGGGSRLFGHSSSSLSADLPLCRPHAYFSLKTRDSRFEGHERVRYSRDQLLQLQEAVEVPDDILKIKQDIEAEIFGENPSWGRAESNLPHQLQNRYSEPDNRDWRGHSGQLPANSDERSWENLRDNREXLVIDSRMLSQXNRHDQLNSQFARTQISSXKGGGPTPTLVKAEVPWSARRGSLSEKDRVIKTVKGILNKLTPEKFDILKGQLIDSGITSADILKDVISLIFDKAVLEPTFCPMYAQLCSDLNEKLPPFPSEDPGGKEITFKRVLLNNCQEAFEGAENLREELKRMTAPEQEMERMDKERLLKLRTLGNIRLIGELLKQKMVPEKIVHHIVQELLGSPDSMFCPVEENVEAICQFFNTIGKQLDESLKSRRINDVYFSRLKELSSNLQLVPRLRFMIRDVIELRASNWVPRREEVKAKTITEIHSEAEKNLGLRPGATASMRNPRGGVQGNASSGGFPIARPGAGGLMPGMPGTRKMPGMPGFDNGNWEMPKTRSMPRGDLPGVQAAGQSNSALLSKSTTLNSKLLPQGSGGIISGRNSALVHGGGTNFGLGPEAAPQLSSPAKTATPVPVSSEKPQHPAARLNTDNLRCRTVSLLEEYFSVQLLEEALQCVEELKSPSYHPEVVKEAISLALDKSPPCVEPVANLIEYLYIKKILTPIDIGTGCLLFGSLLDDIGIDLPKAPSNFGEIIGKLILAGGLDCKLVREILKKVDDGMFQRAIFDSVVGAIRSASGQAVLDAQTSDIEACQSMLK

SEQ ID NO: 3895 - protein, 632 aa, Ralstonia eutropha
MTQSATAHYFVESPSTGALVLGAVGVVFGDIGTSPLYALKECFSKEHGIAFSPDAVLGVISILFWAMIIVVSIKYVVFVMRADNDGEGGVLALMALVLRTVAQRSRKAKILMMLGIFGACMFYGDAVITPAISVLSAVEGLEIAAPQLSQFVIPITLVILAALFLIQRHGTAAVGKLFGPIMTTWFVALGALGILNLVQAPEILKSINPYYAISFLVEHALQAFIVLGSVFLVLTGAEALYVDMGHFGARPIRIGWFVLVMPCLILNYFGQGAMLLHNPAGVENPFFLMVPELLQLPMVLLATSATVIASQAVISGAFSLTSQAIQLGFVPRMRVLYTSAAEIGQIYLPVVNWLLLVLVIGVVISFKKSENLAAAYGIAVTTTMVITTFLAAVCMRNVWKWDPALVAVLGTSFLLVDLAFFAANLLKIAEGGWFPLLLGSAAFFMLMTWYSGRKLLRARSLEDGIPLEPFIAGLLAHPPHRVEGTAVFLTGSIDTVPVSLLHNLKHNRVLHERVVFLTFVTRDIPYVDDDQRVSCKDLGGGAFILKSEYGFKETPDVQKVLDLADRKLGMHFELMETSFFIARESVIPSRLPGMPMWRESLFAWMHQNGAKPSDFFQIPANRVVELGTKVEI

SEQ ID NO: 3896 - protein, 365 aa, Solanum melongena
LVPLFVFILFLHKCFFTTSNNNKKLPPSPRKLPIIGNLHQLGLHPHRSLHKLSKKYGPVMLLHLGSKPVIVASSVEAVRDIMKTNDLVWSNRPKSKMADRLIYGSKDVSFSPHGEYWRQIRSITVLHLLSNKRVQSYRAAREEETSNMIEKLKQMSNSSSSATDLRDLFCWLAYNIINRVALGKKYNDEIDAKATLDKFVELLGTFNVGDYIPCLEWVNKITGFDSKVDKVAKDLDTFLEFVIEAHMIRNEKEENRAGESKDLVDVLLEIQNGKETGFPIQRDSLKALLLDPFSAGTDTIYTVLEWTMTELLRHPRAMEKLQNEVQGLAQEKAEITEDDLPNMHYLKAVIKETLRLHPPIPLLLP

SEQ ID NO: 3897 - protein, 352 aa, Azoarcus sp. EbN1
MTYVQDGNKSELRKAKRQLVTVIDLNKCLGCQTCTVACKNIWTKRPGTEHMRWNNVTTYPGKGYPRDYERKGGGFLRGEPQPGVLPTLIDSGDDFQFNHKEVFYEGKGQTVHFHPTSKSTGKDPAWGYNWDEDQGGGKWPNPFFFYLARMCNHCTNPACLAACPTGAIYKREDNGIVLVDQERCKGHRHCVEACPYKAIYFNPVSQTSEKCILCYPRIEKGIANACNRQCPGRVRAFGYLDDTTSHVHKLVKKWKVALPLHAEYGTGPNIYYVPPMGARGFGEDGEITDKTRIPLDVLEGLFGPEVKRVLAVLHTERENMRAGRGSELMDLLISKKWSDRFGGFTNDPLTQS

SEQ ID NO: 3898 - protein, 311 aa, GIBBERELLA ZEAE PH-1
MTNDNSNNTGASNGEAKSSFTVKAGLAQMLKGGVIMDVVNAEQARIAEEAGACAVMALERVPADIRKDGGVARMSDPAMIKEIQDAVTIPVMAKARIGHFVECQILEALGVDYIDESEVLTPADDESHVEKSPFSVPFVCGCRNLGEALRRIAEGAAMIRTKGEAGTGDVVEAVRHMKTVNRDIAQAKAALAEGGIVRIREMARKLEVDAELLRQTAELGRLPVVNFAAGGVATPADAALMMQLGCDGVFVGSGIFKSGDPAKRAKAIVRATTHFRDAKVLAETSTGLGEAMVGINCDSMKPEEKLAGRGW

SEQ ID NO: 3899 - protein, 309 aa, Agrobacterium tumefaciens str. C58
MQDIQGIVDSIYDSMLPRLGEGKVADYIPELAKVDPNQFGIAITTVDGTTYTAGNALVPFSIQSISKVFMLTLALGKAGETVWNRVGREPSGSSFNSIVQLEHEHGIPRNPFVNAGAIVVTDIVLSGHQPREAIGELLRFVRYLADDDTISIDDTVAKSEQATGFRNFALANFMRSFGNLHHPVEHTLGVYFHQCALSMTCAQLSRAGLFLANRGRNPLSGHTVVSDRRARRINALMLTCGHYDGSGDFAYHVGLPGKSGVGGGIMAVAPGNASIAVWSPGLNKVGNSALGSQALELLATKTGWSVFGA

SEQ ID NO: 3900 - protein, 529 aa, Novosphingobium aromaticivorans
MPVFQIFWKIIAHLRRASSLPLREARHRLPPITSKTDTTMTAFDPDSIRPALAANFIGGEAVVGRGRSFEVLRPSDGQLLGELRAADEQQLCAAVENAAMAQKASGWGAMEPRGRMKLLRRWADLIEADAETLVPLEAVGSSRTLAEVRAWDLPYTAECIRFFAEFADKHGGEIAATTPDKLGFTLTEPYGVIGAIAPWNLPLVMAAWKLGPALAAGNAVVLKPSELTPFSVVRLAELAVAAGIPAGVFNVVQGGGGDIGDALVRHERIAKVSFTGSTRTGQAIMAACAMTGPKPSTLELGGKSPQIVFADADLAKASALVARAITLNSGQVCVAGSRLLVHEKARDEVVERLTTAFEAHRLGTTWDAATTMGPIISEGQLATIDGIVQRARAAGAEAVTGGARAVSPQSGSYYQPTLLAGMSDDNEAVQGEIFGPVLTVQSFADEDEAFALANGTRYGLAAGVHTTDISRALRAVRALEAGTVWVNRYGRSDDFILPTGGFKQSGVGKDLGREAYLGSCKVKTALIQI

SEQ ID NO: 3901 - protein, 215 aa, Clostridium perfringens str. 13
MKIFIDTANVEEIRKASKLGVLAGVTTNPSLIAKEGRDIKEVIEEICSIVDGPISAEVMALECDEMVREGRELAKIHKNIVIKIPMCEEGLKAVKVLASEGIRTNVTLIFSPLQALLAARAGASFVSPFLGRLDDIGNPGIEIVTQIAEMFALHGIDTEIISASVRNPMHVLDSAMAGSHIATIPYNVILQMVKHPLTDAGMKKFIEDYNKAFNK

SEQ ID NO: 3902 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 3903 - protein, 121 aa, Oryza sativa
MAAAEAAAEAAAALEGSEPVDLVKHPSGIIPTLQNIVSTVNLDCKLDLKAIALQARNAEYNPKRFAAVIMRIREPKTTALIFASGKMVCTGAKSEQQSKLAARKYARIIQKLGFAAKLRTS

SEQ ID NO: 3904 - protein, 563 aa, Eremothecium gossypii
MRGQSLLAPLMLVPALVAGTSIQGGKAQLEKRQSMPDDLVAAVGGHLSKLRSKMNVQQGKFFDARGSLKNIADSLGVSEQEVSSVSAELESVMAEMSELFPQDAKQLKFLSEPRGDVRKVREWDNVVRKESLQDYQLRVRKVSDPAGLGVDPDVKQYSGYLDVEAEDKHFFYWFFESRNDPKNDPIVLWLNGGPGCSSMTGLFFELGPSSIDQKLKPVRNPYSWNTNASVIFLDQPVNAGYSYSSNSVANTVAASKDVYAFLELFFRQFPEYQAGQKFHIAGESYAGHYIPAIAAEILSHPDEERSFKLSSVLIGNGLTDPLTQYPYYERMACGGGGEPAILGPEQCSAMNETLPRCLRLIRTCYTLQNVWSCVPASLYCNGNQLTPFQRTGKNVYDVRKECEGQLCYDDMKYSEEYLNTPEVIKAVGAEVDSFTSCNFDVNRNFLLNGDWMKPYQRHVTEILDKGLPVLIYAGDKDFICNWLGNRAWTDELPWKHHDDFTKQPIKPWNGPSGDQAGEVKNYKHFTYLRVFGAGHMVPYDVPENSLDMLNTWLQGDFGMGAQE

SEQ ID NO: 3905 - protein, 819 aa, Aspergillus fumigatus
MSAEPDHAHDKKRVHLHDASGAEKKEELDTSTAILKKKKKPNSLIVTDAVNDDNSVIALSNNTMETLQLFRGDTVLVKGKKRKDTVLIVLADDDLDDGSARINRVVRHNLRVKHGDIITVHPCPDIKYAKRIAVLPIADTVEGLTGSLFDVYLAPYFREAYRPVKQGDLFTVRGGMRQVEFKVVEVDPPEYGIVAQDTIIHCEGEPIQREDEEGNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLAEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASRESILRAQLRKTPVAPDVDIPFIASKTHGFSGADLGFVTQRAVKLAIKESIAAEIERQKQREAAGEDIKMDDEGEEEDPVPQLTRAHFEEAMKSARRSVSDVEIRRYEAFAQSLKNSGGSSFFRFPSSGEIQNNDTFGDAGNDDSLYD

SEQ ID NO: 3906 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGNPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 3907 - protein, 130 aa, Zea mays
MAAASGRAPSACALLLFLLLVVGAAAAAAVVVDANRGEQEQDRDWEQLSAASPSPWSPAPAPAPSPVSFIDCGSACGARCALSSRWNLCRRACGSCCARCNCVPPGTAGNHDVCPCYAAITTRGGRPKCP

SEQ ID NO: 3908 - protein, 448 aa, Arabidopsis thaliana
MVLIQIPMYNEKEVCQLSIGAACRLSWPLDRMIVQVLDDSTDPASKELVNAECDKWARKGINIMSEIRDNRIGYKAGALKAGMMHNYVKQCEFVAIFDADFQPDPDFLERTIPFLIHNHEISLVQCRWKFVNANECLMTRMQEMSLNYHFVAEQESGSSIHAFFGFNGTAGVWRIAALNEAGGWKDRTTVEDMDLAVRACLHGWKFVYVHDVEVKNELPSTFKAYRFQQHRWSCGPANLWRKMTMEILQNKKVSAWKKLYLIYNFFFIRKIVVHIFTFVFYCLILPTTVLFPELQVPKWATVYFPTTITILNAIATPRMIKSLTYIVYCRSLHLLVFWILFENVMSMHRTKATFIGLLEAGRVNEWVVTEKLGDTLKSKLIGKATTKLYTRFGQRLNWRELVVGLYIFFCGCYDFAYGGSYFYVYLFLQSCAFFVAGVGYIGTFVPTV

SEQ ID NO: 3909 - protein, 336 aa, Bacteroides thetaiotaomicron VPI-5482
MIKVGINGFGRIGRFVFRAAMKRNDIQIVGINDLCPVDYLAYMLKYDTMHGQFDGTIEADVENSKLIVNGQAIRITAERNPADLKWDAVGAEYVVESTGLFLSKDKAQAHIEAGAKYVVMSAPSKDDTPMFVCGVNEKTYVKGTQFVSNASCTTNCLAPIAKVLNDKFGILDGLMTTVHSTTATQKTVDGPSMKDWRGGRAASGNIIPSSTGAAKAVGKVIPALNGKLTGMSMRVPTLDVSVVDLTVNLAKPATYAEICAAMKEASEGELKGILGYTEDAVVSSDFLGDTRTSIFDAKAGIALTDTFVKVVSWYDNEIGYSNKVLDLIAHMASVNA

SEQ ID NO: 3910 - protein, 134 aa, Carboxydothermus hydrogenoformans
ITPGKARNIENFRQNIKYKKLIIPEVFWNFTNENILVLEAVYGIKVSERFQLIEMGIDLDQLARDLVEIFILQILEDGYFHADPHPGNIAITPLGDIILYDFGMVGFLNPWLREILITLLISVVRKDFARISEL

SEQ ID NO: 3911 - protein, 306 aa, Zea mays
MRILTGAWAAVFICPISLEPMVDPVTLCTGQTYERANISRWLALGHRTCPTTMQELWDDALTPNATLRQLIAAWFSRRYTRFKKRSADFHGRAADLVGSLRGTAVPRRQPLKGQARVAALRELRTLAAAHQSVTKAIAEAGGVALLTSLLGPFTSHAVGTEAVAILVSGVLLDADTKAALMQPAKVSLVVDMLNEGAADTKINCVRLIRILMVERGFRPETVASLSLLVGVMRLIRDKRHPDGVAAGLELLNSICAVHRPARCMIVSIGAVPQLVELLPELATECVEPALDILDALSAVPEGRMAL

SEQ ID NO: 3912 - protein, 529 aa, Triticum aestivum
  unsure (1)..(529): unsure at all Xaa locations
MAHVHVDEMLHEAAAAAPRSLLIATAVLFSLVVLPLLLRIIAKQGAASDAKLLSLLPSPPTRLPIIGHLHLMGDLPYVSLAGLAXAKYGPELMLVHLGAVPTAVVSSPRTAEAVLRTHDHIFASRPRSMVFDIIMYGQTDSCFSPYGEHFRKARKLVTVHMLNARKIRSQRPAREEEVRQVIGKIAKAAAAREAVDMSELLHSYVNDLVCRAVSGKFSQEEGRNKLFRELTDINAALLGGFNILDYFPSLGRFELVCKVACAKARRVRKRWDLLLDKLIDDHAARMVSREGEAQPEQEEDKDFIDVSLSLQQEYGLTRDHIKAILIDMFEAGTDTSYMTLEFAMAELIRKPHLMKKLQEEVRRNVPNGQEMAAEDDLPNMTYLKAVIKETLRLHPPVPLMIPHFSLDACTVDGYTIPANTRVVINAWALGRHSGYWENENEFQPERFMNGAGVDLKPNEFHYLPFGFGRRMCPGVHSASATVETMLANLMYRFDWKLPPGLKEENIDMTEVFGITVSRKEKLILVPVTA

SEQ ID NO: 3913 - protein, 322 aa, Staphylococcus aureus subsp. aureus MW2
MKHLLVIHTGGTISMSQDQSNKVVTNDTNPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGLNGPKARLKLLVALSNNLDKAEIKSYFEL

SEQ ID NO: 3914 - protein, 342 aa, Solanum tuberosum
MTRRCSHCSTNGHNSRTCPNRGVKLFGVRLTDGLIRKSASMGNLTHFASGSGGGSTPLNGVVHDSPGDTPDHPAVGGGSADGYASEDFVAGSSSSRERKKGVPWTEEEHRMFLLGLGKLGKGDWRGIARNYVISRTPTQVASHAQKYFIRQSNMSRRKRRSSLFDIVADESGDTPMVSRDFLADDPAQAEMQSNNLLPPTPAVDEECESMGSAASANSIDGEHALPIPESSQYQHPLVYPAYVAPFYPMPYPCWPGYTAEPAIAETHEVLKPIAVHSKSPINVDELVGMSKLSLGESIGDAAKPPSLSLKLVEGSSRQSAFHANPSSGSSGMNSSHNPIHAV

SEQ ID NO: 3915 - protein, 407 aa, Nicotiana tabacum
MDEGLSQKAKIQVLWRILHQGQWIRRKGKPAPREIAPVVVSNHVSYIDPIFFFYELFPTIVASESHDSMPFVGTIIRAMQVIYVNRFSPTSRKHAVSEIKRKASCNQFPRVLLFPEGTTTNGRAIISFQLGAFIPGYPIQPVIVRYPHVHFDQSWGNVSLGMLMFRMFTQFHNFMEVEYLPVVSPHENQKENAVRFAQRTGHAVATALNVVQTSHSYGDVLLLAKALEANQENPSLYFVEMAAVEAAFHLSSLEAVEFLDVFLSMNPDSKGQVEIQDFLRVLRLKPCTLSEKMFGFTDMQKSGKMTFKQFLVGSAHILKQPLFHQACESAFTACGDDGKNYILEQEFGYSLMLSLPGLSNNEIHGLFTLFDTDHDGKISKADLIACLRRYPLLIALFSPCLLQQTCP

SEQ ID NO: 3916 - protein, 144 aa, Glycine max
ASTIHNKPTAAQPRAKFDMLQVLGGRGLCNGEAGLKQELKRELGVDEKAPASATSDKEQELEEESSTTQSLASENPPPLKPSQGSKSLKLALSKKPKPPELPLLLPGMIAIVKNPNNPFYMYCGIVQRITDGKAGVLFEGGNWD

SEQ ID NO: 3917 - protein, 131 aa, Leuconostoc mesenteroides subsp. mesenteroides ATCC 8293
SNELGSDGLYNYQSALRVAADDTSKNRGVIVVMNDEIHAARFVTKTHTTNVATFASPLSGTMGLLTKRQIIYFYDLPQREVLPDVDINKNIPVLKAYAGMDGQLLKILADANIDGIIIEALGAGNLSREAA

SEQ ID NO: 3918 - protein, 530 aa, Neurospora crassa
MALETQTKTVVGQFDYSDEDVNKGVVEFLRQMAEGLEKDGASMSQIPTYVTAVPNGTEKGLYMAVDLGGTNFRVCSIQLNGDTTFRLTYTKVAIPRELMVAKTAEELFAFLAKQVEIFLRTHHGEHFEAHIRRRMTMSSPEGFKDENVFRLGFTFSFPVQQLGINKGTLIRWTKGFDIPDAVGKDVCALLQTEIDKLHLPVKVAALVNDTVGTLMARSYSSPGKSGAILGAIFGTGTNGAYVEKLSNIKKPLAGEYDKSTGEMVINTEWGSFDNQLKVLPNTPWDVQLDLATPNPGIQMYEKRVSGMYLGEILRLTVIDLLKNPDVALFKDDNSSYNDWKSTTNIAEHSPIYKQWGLDTSVLSVAAADSTPELSILRQELEANLHIYAPSLEDAQAFKAIAGAIGRRAARLSAVAIAAIVLQTGKLNDPEQDEPIDIGVDGSLVEHYPYFRDMIYEALRVIKGIGEEGAKRIRIGIAKDGSGVGAALIALVAARMEKSTSTADFISDLRLNAKKTDLTAVPEDSELAAGE

SEQ ID NO: 3919 - protein, 762 aa, Agrobacterium tumefaciens str. C58
MSDTTKTASTRTSVTDQEALDFHAQGRPGKLEITPTKPMATQRDLSLAYSPGVAVPVKAIAENPATAYDYTTRGNMVAVISNGTAILGLGNLGALASKPVMEGKSVLFKRFADVDSIDLEVDTEDADEFINCVRYLGPSFGGINLEDIKAPECFIIESRLRELMDIPVFHDDQHGTAIIAAAGLINAIELTGRDFKTTKLVCNGAGAAAIACMDLIKAMGFNPENITLCDTKGVIYQGRTEGMNQWKSAHAVKTDRRTLTEAMNGADVVFGLSQKGAFTEEMIRSMAPKPIIFAMANPDPEITPEEVSRIRDDAIMATGRSDYPNQVNNVLGFPYIFRGALDVRARQINDAMKIAAAQALADLAREDVPDDVAAAYQGNRPRFGSQYIIPVPFDPRLISAIPVAVAKAAIETGVAQREIPDLDAYARELSARRDPMASTTQRLYERVRRSPKRVVFAEAEEEQVMRAAISFTAQGLGTAILLGRDDIIKANAERAGIDLDRANIEITNARLSSRVDAYVDYLYARLQRGGFLLRDVQRLIHNDRNHFAACMVAMGDADAVVTGVTRNYSTALEDIRRCINTKPGHRVIGVSLVVSRNRTVFVADTAVHDMPNAEDLADIAEEAAHLARRFGYEPRVAMLAYSTFGQPVGERSDKVREAVKILDKRNVNFEVDGEMSADVALNHQRMQSQYPFARLSGAANVLVMPAIHSASISTKMLQELGGATVIGPLLVGLDKSVQITSMGAKDSDIVNMAAIAAYNAGR

SEQ ID NO: 3920 - protein, 525 aa, Triticum aestivum/Thinopyrum intermedium alien addition line
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSLGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDTIVPTGV

SEQ ID NO: 3921 - protein, 355 aa, Neurospora crassa
MCFGGRGKDDEAEASRSRDVDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 3922 - protein, 150 aa, Vitis vinifera
LGNLSGDPYILHTNVFIQGKGNREQQFYLWFDPTRNFHTYSIAWSAQHIILLVDNVPIRLFKNAESMGVPFPKNQPMRIYSSLWNADDWATRGGLVKTDWSKAPFTAYYRNFRASTSTSTSTFSDSAFQTQELDAYGRRRLRWVQKNFMI

SEQ ID NO: 3923 - protein, 461 aa, Rhodospirillum rubrum
MWVVARFLLRHSPPEGGRPPDQPAPVRQTTMMRAFTFLPAALVALLAPALAYAQDAAPTLDSGNTAWMLTSTALVLLMTIPGLALFYAGMVRKKNVLATMMQSFIITALVSVVWMVAGYSIAFGTGNAYFGDFSKFLLSDISIDSLNGTFPETVFVVFQMTFAIITPALITGAFAERMKFSAMLWFIGLWVLIVYAPICHWVWSSSGFLFNAGVLDYAGGTVVHINAGVAGLVCALVLRRRAGFGSENMAPYNLSLAVIGAALLWVGWFGFNAGSAVAADGRAGMAMLATQLGAAGATLSWIAAEWLVRGKPSVLGAVSGAVAGLVAITPASGFVLPGGALVIGLVAGVVCFWGATWLKKTLGYDDSLDAFGVHGIGGLVGALLTGVFAAQSVGGEAAVGLLEGNPGQVLTQAWGCLATIVWTAVASYVILKVIDLAIGLRVSPEQESEGLDISLHGERLQ

SEQ ID NO: 3924 - protein, 458 aa, Gymnogongrus dilatatus
PDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYDTLLLPFLKVNLPQGIFFEQDWASLRKVTPVASGGIHCGQMHQLLDYLGDDVVLQFGGGTIGHPDGIQAGATANRVALESMVIARNEGRDYVAEGPQILQDAAKTCGPLQTALDLWKDITFNYTSTDTADFVETPTANV

SEQ ID NO: 3925 - protein, 693 aa, Zea mays
MHGRPRRPAKPEDEEAASAKAAKLRDLQAQVLHNHHGRTYTKEAIGLSFKLLEINPEAYTAWNYRKLAFQHNVKELSDPEAIKSAVDDELRVVEVALRQNPKSYGAWYHRKWLLCQKLAPVDFKREFGLLDKLLKVDARNFHGWNYRRFLARFMGVSDEEELKYTMDKISDNFSNYSAWHNRSILLSNLLIQQSKGFESKQKIFSEEFELVTQALFTDPSDQSGWFYHLWLLAQTSCPDNPQLIASWPSNAAKLSSSLIKEKAEQHRQSSILSRTVPIVLYFNEPVKGLNQSSVNLKSDLEFSKDIIWRPLTMADSGYSNCWATDLQIINECSSLQEYSVEVSIPCSNGIVSRSGSNYNCPVHFTFGIELISNDPVQGLDMFDKPVAWNCSESFQPHGNRDPIPFDLLKITSALIEHDSNWHFERLSEEIDLFRELPDDNSKFGKLTLARLLLACSAIKSRGRSLIERKGYCEEALGLFTDLIHLDPSHKQYYEDERSLVLMDKLTCDMETFMKHCSVQVQPNSAPLNHVQLCRLSLTCIGFAERLLWVQMLDLSHNSLRSVEGLEALQHLVFLNISNNQISGFTALESLTKIISLKVLDLSFNKIGAHSIDTTRYICSSPFSHKMEASEAFEAYQKVNINVEEYWDAILFFRSLKLAQLDIKGNAVASKENFRTIVMMLIPCLKWFDGEDVN

SEQ ID NO: 3926 - protein, 512 aa, Ocimum basilicum
MAALLLLLLLPLLLPAIFLLHHLYYRLRFRLPPGPRPLPIVGNLYDVKPVRFRCFADWAQSYGPIISVWFGSTLNVIVSNTELAKEVLKEKDQQLADRHRSRSAAKFSRDGQDLIWADYGPHYVKVRKVCTLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPSLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPCEFRPERFLEEDVDMKGHDFRLLPFGAGRRVCPGAQLGINLVTSMIGHLLHHFNWAPPSGVSSDELDMGENPGLVTYMRTPLEAVPTPRLPSDLYKRIAVDL

SEQ ID NO: 3927 - protein, 372 aa, Corynebacterium efficiens YS-314
MSSSEKNGSLDASAGASVDVDAVILVGGKGTRLRPLTNNTPKPMLPTAGHPFLKHLLARIKAAGITHVVLGTSFKAEVFEDYFGDGSDLGLEIEYVVEDQPLGTGGGIRNVYDKLRHDTAVVFNGDVLSGADLGDILATHREKEADLTMHLVRVANPRAFGCVPTDADGRVLEFLEKTEDPPTDQINAGCYVFQRELIASIPADRVVSVERETFPQLLQEGRRVYGHVDTSYWRDMGTPQDFVRGSSDLVRGIAFSPLLEGQTGEELVDPSAGVRDGVILLGGTVVGRGTEIGAGCRLDGTVVFDGVTIEPGAFIENSIISSGVRIGANAHISGCVIGEGAQIGARCELSSGMRVFPGVVIPDGGIRFSSDQ

SEQ ID NO: 3928 - protein, 484 aa, Saccharomyces cerevisiae
MADKIERHTFKVFNQDFSVDKRFQLIKEIGHGAYGIVCSARFAEAAEDTTVAIKKLTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGSLLDLEKELEFGLDRKYF

SEQ ID NO: 3929 - protein, 446 aa, Triticum aestivum
  unsure (1)..(446): unsure at all Xaa locations
MAEQVVADLREKCATPPSLLCDVAAAMADEMCAGLGKEGGSRVQMLLSYVDKLPTGREEGLFYGLDLGGTNFRVLKVQLGGNDKHVISCESREVAIPPHLMSGSSSELFGFIASELAKFVADEEKGTSLSNEKTRKLGFTFSFPVRQRSVASGTLVKWTKAFSIEDAVGKDVVAELQTAMQKQGLDMHVAALINDAVGTLAGARYYDEDVVAGVIFGTGTNAAYVEKANAIPKWEGELPNSGEMVINMEWGNFYSCHLPVTEYDQALDSESLNPGEQIYEKLTSGMYLGEIVRRVLLKLSLQSGIFGEIDHTKLKTHFHXLRTPHISAMHHDNTPDLKIVEEKLKEILEIAGTSLETRKMLVEICDIVTRRAARLAAAGLAGILKKLGRDGSVDKRRSVIAIDGGLFEHYAKFSKCLEATLIELLGEESSKFVVVKHADDGSGIGA

SEQ ID NO: 3930 - protein, 243 aa, Oryza sativa (japonica cultivar-group)
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 3931 - protein, 196 aa, Mitthyridium sp. Wall 3798
GGAKKVVISAPSKDAPMFVMGVNEEKYTNEDIVSNASCTTNCLAPLAKVINDKFGILEGLMTTVHATTATQKTVDGPSNKDWRGGRSAGSNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFVNS

SEQ ID NO: 3932 - protein, 280 aa, Glycine max
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPGTPLSAIEYILDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 3933 - protein, 555 aa, Zea mays
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDRSGHLKLSDFGLCKPLDSSNFPNLNEPDYMSGKVTTPLPDTTRLSNPSAPRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKPKRPTIKTMFERMDGEEPVQGSFLSMLPPEGQPSSHSSVPQEKYQPRRK

SEQ ID NO: 3934 - protein, 330 aa, Schizosaccharomyces pombe
MSGSCQFLSRETLSSSLGWIPLINALREIFTENVVCPTRLHYPIDEDNPSSTANNILLIMPCWIPGKFLGVKQVNVFPENTKHGLPSLSSHYLLSDATTGCHLAQLDGNELTSRRTAAASALASSYLSKEDSTSLLIIGSGKVAEKLIHAHCSVRPIRSVRIWNHRFESAKSLASRASKELPSIQIDAVPIQNLENAVKCSDIISSATLSKKPIIVGSWINPGTHIDLVGGFTPHMHEADSKCIQISNVFVDTRKGALHEAGDLLTPIKEGLFSPNEVIADLFDLCNNKHSGRSQLKNPAEAITLFKSVGDSREDLAAASLAYKVHNKSS

SEQ ID NO: 3935 - protein, 528 aa, Pseudomonas putida [sequence omitted]

SEQ ID NO: 3936 - protein, 917 aa, ASPERGILLUS NIDULANS FGSC A4
MEQQGDLQAASNYINNVLLARGLVKSGRPIDFANPENEEGGVATTMARIINLVNDLVLRRDREAEHRENLATTIRTLRAEESHKAVEMSELSRSLALAEAQERALKTSMSSAEATIRGLKDQVQRMKTTVQQVRSQCANDIRKRDLELQKLKAHLADRQRGKRDGLGVTTININPAASQSSRRYLSGGEGVHDPGYSLKQETNEFLTQLLQNLSDENDSLISLARNTVFTLKELQGLSSTEEPAVDNGYLQGSASTAQRSTYGGAAVTSLPASCEELSGEMDQVLEHLRTLLTNPSFVPLEEVEVRDEEIKRLREGWEKMESRWRQAVTMMDGWHKRIAHGGGSVRAEELRMGLKLNDHVDPRYSQVRDNDVAMPSPIFEDQEDEEDEYFGVEATETEPNDDAEPAPDEPQETSSRALKERTDNTASAKHPPRKEVSFTEKDRKSPSKKQQEDDTMPIKAHQSDAVTRRPSRKRVEPKGPRPAPTRMSVPQKLAAAESEARAAEKARQEQESRKRSRGSKVARKKTGDRRRSTLTSDELGELLGMKPSDSLGTMPDTFTGWVAHGPKSPLTYGAFTPKPFEETDIEVQITHCGICGSDIHTIRSGWAPADYPCVVGHEIIGTATRIGRAVNNKQNIQPGDRVGIGAQCSSCLRPDCEACADGEESYCPKMVGTYNSRFPDGSKAYGGYANRWRGPGHFVFRIPEQLSSAEAAPLLCGGVTVFAPLRRFGAGPGKRVGIVGIGGLGHMGLLFARALGSDAVVAISRSSSKKSDAIGPLPNKLGADAFIATGEDKNWAKTHARSLDIIICTVSGENMPLSGYLRLLKRNGVFVQVGAPEEPLPPLRAFSLIQKGVKVTGSSIGSPEDIRQMLNLAAEKGVRPWVQTRPMEEVNLALQEMHEGKARYRFVLENGAKAGKL

SEQ ID NO: 3937 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 3938 - protein, 509 aa, Hordeum vulgare subsp. vulgare
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAGQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGNHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEEL

SEQ ID NO: 3939 - protein, 430 aa, Arabidopsis thaliana
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSSYYRDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 3940 - protein, 472 aa, Ptilophora pinnatifida
ESGVIPYAKMGYWDPDYVIKETDVLALFRITPQPGVDAVEASAAVAGESSTATWTVVWTDLLTACDLYRAKAYRVDPVPKAPDQYFAYISYDIDLFEEGSIANLTASIIGNVFGFKALKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAGTGEVKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGEDVVLQFGGGTIGHPDGIQAGATANRVALEAMVIARNEGRNYVEEGPQILRDAAKTCGPLQTALDLWKDITFNYTSTDTADFVETPTANV

SEQ ID NO: 3941 - protein, 492 aa, Hordeum vulgare
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRFDPTRHAEKYPMPPRVLSGCREKCIIDKENNFKQAGERYRSFDPARQDRFLQRWVDALTDARVTHEIQSIWVSYWSQCDASLGQKLASRLKIKPNM

SEQ ID NO: 3942 - protein, 593 aa, Pisum sativum
METETETPNGSTPCPTSAPSAIPLRPSSCDGTMGRHLARRLVEIGVRDVFSVPGDFNLTLLDHLIAEPELNLVGCCNELNAGYAADGYGRAKGVGACVVTFTVGGLSILNAIAGAYSENLPVICIVGGPNSNDYGTNRILHHTIGLPDFSQELQCFQTITCFQAVVNNLDDAHELIDTAISTALKESKPVYISIGCNLPAIPHPTFARDPVPFFLAPRVSNQAGLEAAVEEAAAFLNKAVKPVIVGGPKLRVAKAQKAFMEFAEASGYPIAVMPSGKGLVPENHPHFIGTYWGAVSTSYCGEIVESADAYVFVGPIFNDYSSVGYSLLIKKEKSLIVQPNRVTIGNGLSLGWVFMADFLTALAKKVKTNTTAVENYRRIYVPPGIPLKREKDEPLRVNVLFKHIQALISGDTAVIAETGDSWFNCQKLRLPENCGYEFQMQYGSIGWSVGATLGYAQAATDKRVIACIGDGSFQVTAQDISTMIRCGQRSIIFLINNGGYTIEVEIHDGPYNVIKNWDYTGFVSAIHNGQGKCWTAKVRTEEDLTEAIATATGAEKDSLCFIEVFAHKDDTSKELLEWGSRVAAANSRPPNPQ

SEQ ID NO: 3943 - protein, 177 aa, Shewanella oneidensis MR-1
MSKAKIGIVTVSDRASAGIYEDISGKAIIDTLNDYLTSEWEPIYQVIPDEQDVIETTLIKMADEQDCCLIVTTGGTGPAKRDVTPEATEAVCDRMMPGFGELMRAESLKFVPTAILSRQTAGLRGDSLIVNLPGKPKSIRECLDAVFPAIPYCIDLMEGPYLECNEAVIKPFRPKAK

SEQ ID NO: 3944 - protein, 112 aa, Zea mays
MAAADPRLAEITSSIRVIADFCKAQIMFENITTLQLDPKAFRDTIDLFVERYEDPAIAVAGGGEATWLIFGPAIALDIGAKFVPLRKPKKLPSEGMCEDYSLEYGADKIEMH

SEQ ID NO: 3945 - protein, 287 aa, Zea mays
  unsure (1)..(287): unsure at all Xaa locations
FSRFLLYEVDAIRKTYERANISRWLALGNRTCPTTMQELXDDALTPNATLRQLIAAWFSRRYTRFKKRSADFHGRAADLVGSLRGTAVPRRQPLKGQARVAALRELRTLAAAHQSVTKAIAEAGGVSLLTSLLGPFTSHAVGTEAAAILVSGVLLDADTKAALMQPAKVSLVVDMLNEGAADTKINCVRLIRILMVERGFRPETVASLSLLVGVMRLIRDKRHPDGVAAGLELLNSICAVHRPARCMVVSIGAVPQLVELLPELATECVEPALDILDALSAVPEGRM

SEQ ID NO: 3946 - protein, 389 aa, Glycine max
MVDQVQHPTIMDKVAGQLHLRSGLSSGIRSYDGAYRHPAMYQRPSFGNYSNAALQFPVMPTCKATMDLSATATSASPVFVAAPAEKGHFLLDFLMGGVSAAVSKTAAAPIERVKLLIQNQDEMIKTGRLSEPYKGIGDCFKRTMADEGAISLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLASDGVAGLYRGFNISCVGIIVYRGLYFGLYDSVKPVVLTGSLQDSFFASFALGWLITNGAGLASYPIDTVRRRMMMTSGEAVKYKSSLDAFTQILKNEGAKSLFKGAGANILRAVAGAGVLAGYDKLQVLVFGKKYGSGGA

SEQ ID NO: 3947 - protein, 453 aa, Bartoniella crenata
KETDVLALFRVSPQPGVDPVEASAAVAGESSTATWTVVWTDLLTACDLYRAKAYKVDAVPNTTDQFFAYISYDIDLFEEGSIANLTASIIGNVFGFKAVKALRLEDMRIPVAYLKTFQGPATGLIVERERMDKFGRPFLGATVKPKLGLSGKNYGRVVYEGLRGGLDFLKDDENINSQPFMRWKERFLYSMEAVNRSIAATGEMKGHYMNVTAATMEEMYERAEFAKQLGTVIIMIDLVIGYTAIQTMGIWARHNDMILHLHRAGNSTYSRQKIHGMNFRVICKWMRMAGVDHIHAGTVVGKLEGDPLMIRGFYNTLLFAHLDINLPQGIFFQQDWAALRKVTPVASGGIHCGQMHQLLDYLGNDVVLQFGGGTIGHPDGIQAGATANRVALEAMVLARNEGRDYVAEGPQILVDAAKTCGPLQTALDLWKDITFNYTSTDTADFVETPTANV

SEQ ID NO: 3948 - protein, 333 aa, Vibrio vulnificus CMCP6
MTIKVGINGFGRIGRLAMRAAFDWPELEFVLINDVAGDSTTLGHLLEFDSVQGRWHHEVTVQGQQLHINGHVIETTQQRDISAVDWSGCDVVIEATGVHRKSRFLNQYLEQGVQRVVVSAPVKEEGIANIVVGVNDEIFNPEQHRIVTAASCTTNCIAPVVKVIHEKLGIEQASFTTIHDLTNTQTILDAPHKDLRRARACGMSLIPTTTGSATAIVEIFPELKDRINGHAVRVPLANASLTDIIFDVKRDTTAEEVNALLKEASQGELNGILGFEERPLVSIDYRGDQRSTIVDALSTMVVGTRMVKIYAWYDNEMGYATRTAELVRKVGAA

SEQ ID NO: 3949 - protein, 480 aa, Martensia sp.3
QVIKNERYESGVIPYAKMGYWDPNYVTKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWARKNDMILHLHRAGNSTYSRQKVHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALEAMVIARNEGRDYVAEGPQILRDAAKTCGPLQTALNLWKDITFNYTSTDTADFVETPTANV

SEQ ID NO: 3950 - protein, 354 aa, Pseudomonas syringae pv. syringae B728a
MALISMRQMLDHAAEFGYGVPAFNVNNLEQMRAIMEAADKTDSPVIVQASAGARKYAGAPFLRHLILAAIEEFPHIPVVMHQDHGTSPDICQRSIQLGFSSVMMDGSLREDGKSPADYDYNVDVTRRVVSFAHACGVSVEGELGVLGSLETGMAGEEDGVGAEGVLDHSQMLTDPEEAADFVKRTQVDALAIAIGTSHGAYKFTKPPTGDILAIERIKEIHKRIPNTHLVMHGSSSVPQEWLKIINEFGGDIKETYGVPVEEIVEGIKHGVRKVNIDTDLRLASTGAIREFMAKNPSEFDPRKYLAKTVSAMRDVCIARYEAFGTAGNASKIKPISLDAMFERYARGELDAKVN

SEQ ID NO: 3951 - protein, 1096 aa, Oryza sativa
MQATIGRDGESAMLVSASVGGGWREGRGGVAGGEEASRWRGVGGVRVQRRWREGAALAELGQVFDRLPVGSIWAVRFVKLRGIRRRELFEGTEFDLENGVVSGCVRIGSGGADFLDGTSSVYLEELQRAWEADPTSVDESWDNFFRNFVGQAATSPGISGQTIQESMRLLLLVRAYQVSGHLKAKLDPLALEERPIPDVLDPAFYGFSEADLDREFFLGVWRMAGFLSENRPVQTLRSVLERLEQAYCGTIGYEYMHIPDREKCNWLRDRIETVNAREYSYDRRQVMLDRLMWSTQFESFLAQKWTTAKRFGLEGAETLIPGMKEMFDRAADLGVESIVIGMPHRGRLNVLGNVVRKPLRQIFSEFSGGTKPAEEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYTTGGTIHIVVNNQVAFTTDPRAGRSSQYCTDVAKALDAPIFHVNGDDLEAVVHVCELAAEWRQTFHSDVVVDIVCYRRFGHNEIDEPSFTQPKMYKIIRNHQSALEIYQNRLLESGKISKEDIDKMQKKVSTILNDEFQNSKEYIPNKRDWLSAYWTGFKSPEQISRIRNTGVKPEILKRVGEAMTTLPENFKPHRAVKKIFELRRQMIETGEGIDWAVGEALAFATLIIEGNHVRLSGQDVERGTFSHRHAVIHDQETGEQYCPLDNLVMNQDEELFTVRLVSLGSSTANLSADHDTSNLSSPHIAASSLSEFAVLGFELGYSMENPNSLVLWEAQFGDFSNGAQVIFDQFLSSGEAKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGIKRLVLCSGKVYYELDEERRKKERDDVAICRVEQLCPFPYDLIQRELKRYPNAEIVWCQEEPMNMGAYSYINPRLLTAMRALGRGTIDDIKYVGRAPSAATATGFYSVHVQEQTELVQKALQRDPINSPF

SEQ ID NO: 3952 - protein, 306 aa, Zea mays
  unsure (1)..(306): unsure at all Xaa locations
EWPRRRRPSCPPISPASPTSAARRRRPLPPSHSSFASASRAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWXDVVIAYXEPVWAIGTGKVATPEQAQEVHAAVRDWLTTNISPDVASSTRIIYGGSVNAANCAELAKKEDIDGFLVGGASLRXPDFATIINSVTAKKVAA

SEQ ID NO: 3953 - protein, 368 aa, Neurospora crassa
MSGTDYKFEGWLGFDKSSAHGNMQWGEFEPKPWEETDIDIKIECCGVCGSDIHTLRSGWGPTNYPCCVGHEVVGTVVRAGSKVEGGIKVGDRVGVGAQSDACRNRTDKHCKICADGNYNYCRVHHVGTYNGVYMNGGKSYGGYATYQRVPSFFAVKIPESMPSSHAAPMLCAGVTTYAPLKFHGVGPGKRVGVIGLGGLGHFGVMWAKALGADEVVVISRSSSKKADAMAMGATGFIATGEDPEWLNKNRSSLDIILCTASSADMPFNDYLFLLDLDGVFIQVGAPDDDLPRIKQMALIFNRIKLTGSLIGSPDDIREMFQLAVDKKVQPWISEIPMKEANKAIVDFEDGKPRYRFVLKNEDYTPVQA

SEQ ID NO: 3954 - protein, 296 aa, Xylella fastidiosa 9a5c
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHRKHGQAVREILRDTLLPVDKN

SEQ ID NO: 3955 - protein, 104 aa, Amaranthus blitoides
NVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRS

SEQ ID NO: 3956 - protein, 347 aa, Cytophaga hutchinsonii
MIQAKGYAAQNEKTDLAPWNFERRDVGPHDVQFDIHYCGVCHSDLHQIRNDWFKGIFPMVPGHEIVGKIVKVGAHVTKFKIGDLAGTGCLVDSCRTCDNCKDGLEQYCVNGNSGTYNSLEQDKKTPTYGGYSNTIVVHEDFVLHISDKLDLAAAAPLLCAGITTYSPLRHWKVGKGHKLAVLGLGGLGHMAVKFGVAFGAEVTVLSTSPNKEADAKKLGAHKFVVTSDAAQVNSVKGYFDFILDTVSAPHDVNMYMSLLKTNGVHICVGVPPTPYEVHAFSIIGGRKSLAGSNIGGLPETQEMLDFCAQHNITSDIERIDIKNIHASYERMLKGDVRYRFVIDMSTL

SEQ ID NO: 3957 - protein, 139 aa, Triticum aestivum
  unsure (1)..(139): unsure at all Xaa locations
MSGVTVDEDKKPADDGGGAHINLKVKGQDGNEVFLRIKRSTQLKKLMNAYCDRQSVDLNSIAFLFDGXRRLRGEQXTPDELGDGGKATRFDAMLHQXTGGCLPWPLRRTCCSLAVLCPMLPFKTKIKCEVKEFKVWSVP

SEQ ID NO: 3958 - protein, 117 aa, Glycine max
MATRSKREAEGVGDGDGNKIVWNEAQQRFETQDKEAFVEYALKEKGKVMVMDLIHTFVPPSKRGLGLASHLCVAAFQHAQSHSLSIIPTCSYVSDTFLPRNPSWNSVVYTEGGKSNI

SEQ ID NO: 3959 - protein, 275 aa, Cucurbita pepo
MAGRSSPREEFVYLAKLAEQAERYEEMVEFMEKVSAAVDNEELTVEERNLLSVAYKNVIGARRASWRIISSIEQKEESRGNDDHVSIIRDYRSKIETELSNICGFRILNLLDSRLIPSAASGDSKVFYLKMKGDYHRYLAEFKTGAERKEAAESTLTAYKSAQDIANAELPPTHPIRLGLALNFSVFYYEILNSPDRACSLAKQAFDEAIAELDTLGEESYKDSTLIMQLLRDNLTLWTSDIRGSRDDIKEAAPKRDCTNSSEQIDLHVQDSTSP

SEQ ID NO: 3960 - protein, 324 aa, Neisseria meningitidis MC58
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 3961 - protein, 757 aa, Cytophaga hutchinsonii
MSISKEDALNYHTQGKPGKIEVVPTKALSTQLDLALAYSPGVAEPCKEIAANKEDAYKYTAKGNLVAVISNGTAVLGLGNIGPDASKPVMEGKGVLFKKFAGIDVFDLEVNCEDPEQFIKIVESLEPTFGGVNLEDIKAPECFIIEQELRKRMNIPVMHDDQHGTAIISSAALLNALEVVGKKAEDVNVVVSGAGAAAISCTRLYKHLGVRSENIVMCDINGVLRKDRTDLDVSQLEFATGRDLYTLADAMPGADVFIGLSAGNILKPEVLATMAKDPIVFALANPTPEIDYHLALNTRPDVIMATGRSDYPNQVNNVLGFPYIFRGALDVRATEINEAMKLAAVYAIAKLAKEVVPDTVNKSYGDNKITFGKNYLIPKPLDPRLITTISPAVARAAMESGVAKKDIEDWGAYEVELLQRIGIDQRLMSRIITQAKQEPKRVVFAEADNLKILKAAQIISDEGIAFPILLGNAEKIKELLIENALVIKDFLIVDPFEEKEKRSLYGNLLHNKRKRKGITAEIGRKLMRNRNYYGAMMVETGEADAFISGLTQEYGETIKPALQVIGVEEGIKRVAGMYILSNRKGVYFFSDTTVNMDPTAEELVDIIGVTARGVKFFNFEPRIAMLSYSNFGSNEGAVPTKVALATRLAKEKYPDLIIDGDIQANVAVDTALQEEMYPFSALAKDGANTFIFPALTSGNIAYKLLQEIGGMEAIGPLLMGMAKPVHILQLGSSVREIVNMVAIAVVDAQSQNSKINL

SEQ ID NO: 3962 - protein, 495 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFCTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTHEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIQKPNDFKQPGERYRSWDANRQERFVRRFADSLGHPKVSQELRSIWIDLLSKCDASLGMKIATRLNMKPNM

SEQ ID NO: 3963 - protein, 74 aa, Zea mays
  unsure (1)..(74): unsure at all Xaa locations
ASEARERSARIGLVEPDKARGVEDVLLRAAXSVAPPPPVSEGRLISLLEQINTHTSKQTKVTIQRRRSDLDDDD

SEQ ID NO: 3964 - protein, 154 aa, Glycine max
MGSEGSTVVVPRNFRLLEELERGEKGIGDGTVSYGMDDADDIYMQSWTGTIIGPPGGVHEGRIYQLKLFCGKDYPDNPPTVRFQTRINMTCVNQETGVVEPHLFPMLANWQRECTMEDILMQLKKEMMSPQNRKLAQPPEGNEDGRIDQKGLVL

SEQ ID NO: 3965 - protein, 466 aa, Nannochloropsis oceanica
PYAEMGYWDANYTIKDTDVLALFRITPQPGVDPIEAAAAIAGESSTATWTVVWTDLLTACDVYRAKAYKVDSVPGTSDQYFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLVGSVIIMIDLVIGYTAIQSMAVWSRKNDMILHLHRAGNSAYARQKNHGINFRVICKWMRMAGVDHIHAGTVVGKLEGDPLMVKGFYNVLLQTSLDINLPQGIFFEQDWASLRKTLPVASGGIHCGQMHQLLNYLGEDCVLQFGGGTIGHPDGIASGATANRVAMESVLLAKYEGKDYINEGPKILRAAAESCAPLRSALDLWKDIAFNYTSTDTADYIETATKQ

SEQ ID NO: 3966 - protein, 558 aa, Triticum aestivum
  unsure (1)..(558): unsure at all Xaa locations
MYPTLVRPAGDPCTRQAARPRQPQPHRSCRGTANVIDAVQQRAAPGRAKRASPPSGERAPPPRGLKVGRQQQHQAREGXRRMCNGGRASRRHRRAVRAHLRRQPRQTPLFSGRPSAGIXADPNEVAAVILGGGTGXTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGRXSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 3967 - protein, 200 aa, Glycine max; identical to SEQ ID NO: 1856

SEQ ID NO: 3968 - protein, 240 aa, Zea mays
MGRGRVELKRIENKINRQVTFAKRRNGLLKKAYELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKEQMFCEANKCLRRRLEESNQVIWQHAWEQSERHSEVQPQQLNGNNFFHPLDGAGEPTLQIGYPSEALTSSCMTTFLPPWLP

SEQ ID NO: 3969 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRREVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTLLFSR

SEQ ID NO: 3970 - protein, 246 aa, Pseudomonas fluorescens PfO-1
MRARKLEVYNARHRDLAQKRCVMQPFVIAPSILSADFARLGEEVDNVLAAGADFVHFDVMDNHYVPNLTIGPMVCAALRKYGVTAPIDAHLMVSPVDRIVGDFIEAGATYITFHPEATLHVDRSLQLIREGGCKSGLVFNPATPLDVLKYVIDKVDMVLLMSVNPGFGGQKFIPGTLDKLREARAIIDASGRDIRLEIDGGVNVNNIREIAAAGADTFVAGSAIFNAPNYQEVIDKMRSELALARP

SEQ ID NO: 3971 - protein, 454 aa, Lupinus luteus
MASRPIVPLQPQQAKGEGVIGGRRKQENKNGAANGKNRVVLGDIGNLDRVKGANINLNRPITRSLCAQLLAKAEAGENDKNLAIPNVTGPKPQVADGVVAKRRVAPKPAEKKVTAKPKPVEIVEISSGKEVQKDKSANKNKEQGDALSKKKSQTLTSVLTARSKAACGLTEKPKDQIIDIDAGDSRNELAAVEYIEDMYKFYKLAENENRPHQYMDSQPEINERMRAILVDWLIDVQTKFDLSLETLYLTINIVDRFLAVKTVLRRELQLVGVSAMLMASKYEEIWPPEVNDFVCLTDRAYTHEQILVMEKIILGKLEWTLTVPTTFVFLTRFIKASVPDQELENMGHFLSELGMMHYATLVYCPSMVAASAVFAARCTLNKTPIWNETLQLHTGYSEEQLMDCARLLVSFHSTLANGKLKVLYRKYSDPQRGAVSMHPPAKNLMPESSCGSRV

SEQ ID NO: 3972 - protein, 197 aa, Staphylococcus aureus subsp. aureus MW2
MILVIDNNDSFTYNLIDYIKTQTKLTVQVVGIDNLLIEDVINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHITFPVFGVQYHPESILSEYGYRQVELFLSKVGDYCENRI

SEQ ID NO: 3973 - protein, 187 aa, Yersinia pestis CO92
MTVSASKTAQQLKYIKDSIKTIPDYPKAGILFRDVTSLLENPKAYSASIKLLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 3974 - protein, 332 aa, Ralstonia metallidurans
MTIKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEMARVVAK

SEQ ID NO: 3975 - protein, 488 aa, Hecatonema sp. K-0229
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLSINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 3976 - protein, 339 aa, Glycine max
  unsure (1)..(339): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAXVGKVLPELNGKLTGMAFXGFPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 3977 - protein, 382 aa, Xanthomonas campestris pv. campestris str. ATCC 33913
MPVTTKLPKVGTTIFTVMSQLAAEHGAVNLGQGFPDFAVPQRLVDALGQAMAAGHNQYPPMTGVAALRQAIAGKAQRCYGAQVDADTEITVTSGATEAIFNAIHAVVRAGEEVIVLDPAYDCYEPAIDLAGARAVHVALDPQTFAVDWDALRAAITPKTRLLMINSPHNPSGAMLSAADMQTLTELLHGTDIFLLSDEVYEHIVFDGRRHESVLRWPELRARAFVISSFGKTYHCTGWKIGYAIAPPALSAEFRKVHQYNTFTSFGPAQHAFAAMLRDEPEHDEQLGAFYQAKRDRFREQLLTTRLVPLPVPGGYFQLVDYSAISDLPDTEFVKWLTVEKGVAAIPLSPFYETAPAGQRLARLCFAKNDATLDAAIARLQQL

SEQ ID NO: 3978 - protein, 923 aa, Melilotus alba
  unsure (1)..(923): unsure at all Xaa locations
MELQIIWILRLVVACVLCLCIFIRSASSATKGFESIACCADSSYKDLKTTLNYTTDYIWFSDKXSCRQIPEILFSHRSNKNVRLFDIDEGKRCYDLPTIKDQVYLIRGTFPFDSLNSSFYVSIGATELGEVRSSRLDDFEIEGVFRATKDYIDFCLLKKDVNPFISQLELRPLPEEYLHGLATSVLKLISRNNLGGTEDDIRFPVDQNDRIWKATSTPSSALPLPSNVSNVDLKGSVTPPLQVLQTALTHPERLEFVHDGLETDDYEYSVFLYFLELNGTLKAGQRVFDIYLNNEIKKEKLDVLAGGSKNSYTVLNISANGSLNITLVKASGSEFGPLLNAYEILQARPWIEETNQIDLEVVQMMREKLLLHNQDNEALESWSGDPCMLFPWKGIACDDSNGSSIITKLDLSSNNLKGTIPSTVTEMTNLQILNLSHNHFDGYIPSFPPSSVLISVDLSYNDLTGQLPESIISLPHLKSLYFGCNQHMSDEDTAKLNSSLINTDYGRCKAKKPKFGQVFVIGAITSGSLLITLAVGILFFCRYRHKSISLEGFGGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEAAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESAITIQTLSHPQPR

SEQ ID NO: 3979 - protein, 521 aa, Zea mays
LVSPGPGLLICSSRGFGPMAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFGFIASELAKFVDDDEKCANISNGKKREIGFTFSFPVKQRSVASGTLVKWTKAFSINDAVGEDVVAELQTAMEKQGLDMHVAALINDAVGTLAGARYYDKDVVAGVIFGTGTNAAYVEKANAIPKWEGELPHSGDMVINMEWGNFFSSHLPITEYDQELDKESLNPGEQIYEKLTSGMYLGEIVRRVLLKISLQSAIFGDIDHTKLQTHFLLRTPHISAMHHDETSDLKIVAENFEQNLEITGTSLEARKLVVEIRDIVATRAARLAAAGLAGILMKIGRDHSVEDQRSVIAIDGGLFEHYTKFRRCLETTLGELLGDEASKAVAIKHADDGSGIGAALIAASQSQYKNDLVAVKHADDGSGVKYAEDKRADDGSEIGAALIAASQSQ

SEQ ID NO: 3980 - protein, 367 aa, Rhizobium etli
MADAKLQAVLSALSPMARQLNALPSNQPGRDANCVKLNTNENPFPLPMMVLQSALAALERHYLYPEDDNLSLRDAAASAYGLSQDQVVAGNGSSELLGLIYRAFLDPGDSVAMISPGFSFNRKLAKLQGARFLEIEWGESYSLPIEQLLLGPAKDAKFILLANPNNPTGTFVPVAEIDRLVAQSDQLIVVDEAYVDFAPDDALRLVDRHPNLLVLRTLSKGFAAAGIRVGFGFGHPELIGRLRNLQNVFNMNVIGHAVGISILSHRADYDENHRYIKHERHRTTTALSQLGFSVIPSHTNFLLARVPPGRDGKWWQASLDRQNILVAVFPDAGLENFIRVSIGTRTQMDAFLSAARDIISGSMKTQS

SEQ ID NO: 3981 - protein, 400 aa, ASPERGILLUS NIDULANS FGSC A4
MSSSEEKVRTSGEVSRPEPTLPTVNPAVDKPEPPKPTFHPAVYVTSWIALSSSVILFNKHILDYAQFRFPIILTTWHLAFATFMTQVLARTTTLLDGRKTVKMTGRVYLRAIVPIGLFFSLSLICGNVTYLYLSVAFIQMLKATTPVAVLLATWGMGMAPVNLKVLTNVSVIVFGVIIASFGEIKFVFIGFLFQIAGIIFEATRLVMVQRLLSSAEYKMDPLVSLYYFAPVCAVMNGVTALFLEVPTLTMDHIYNVGVWTLLANAMVAFMLNVSVVFLIGKTSSLVMTLCGVLKDILLVVASMVIWNTPVTALQFFGYSIALIGLVYYKLGGDKIKEYTSQANRAWAEYGATHPAQRRFVIIGAALLSFFLLVGSMAPSYAPDSVANVKGMLGGASTGNA

SEQ ID NO: 3982 - protein, 471 aa, Pterocladiella melanoidea
  unsure (1)..(471): unsure at all Xaa locations
SGVIPYAKMGYWDPDYVVKDTDVLALFRVTPQPGVDPVEASAAVAGESSTATWTVVWTDLLTACDLYRAKAYKVDAVPNSSDQYFAFIAYDIDLFEEGSIANLTASIIGNVFGFKAVKALRLEDMRIPVAYLKTFQGPATGVIVERERMDKFGRPFLGATVKPKLGLSGKNYGRVVYEGLRGGXXFLKDDENINSQPFMRWKERFLYSMEGVNRAIASTGEIKGHYMNVTAATMEDMYERAEVAXXXXXXXXXXXXVIGYTAIQTMAVWARKNDMIXHLHRAGNSTYSRQKSHGMNFRVICKWMRMAGVDHIHAGTVVGKLEGDPLMIRGFYNTLLLPHLDINLPQGIFFEQDWASLRKVTPVASGGIHCGQMHQLLDYLGVDVVLQFGGGTIGHPDGIQAGATANRVALEAVLIARNEGRDFVAEGPQILRDAAKTCGPLQTALDLWKDITFNYTSTDTADFVETPTANV

SEQ ID NO: 3983 - protein, 333 aa, Rhodobacter sphaeroides
MTVKVAINGFGRIGRNVLRAIIESGRTDIEVVAINDLGPVETNAHLLRFDSVHGRFPATVTTTEKTIDVGRGPMDVTAIRNPAELPWGHVDIVLECTGIFTDKEKAKVHLESGAKRVLVSAPSTGADKTIVYGVNHETLTKDDLIVSNASCTTNCLSPVAKVLNDTIGITKGFMTTIHSYTGDQPTLDTMHKDLYRARAAALSMIPTSTGAAKAVGLVLPELKGKLDGVAIRVPTPNVSVVDLVFEASRATSVEEVNAAIREAADGKLKGILGYTDQPNVSMDFNHDPHSSIFHLDQTKVMEGNMVRILTWYDNEWGFSNRMADTAVAMGKLI

SEQ ID NO: 3984 - protein, 383 aa, Ceratopteris richardii
MNTFLSSGPHTYLNNLRCGEWGSGTAPGPIADPKSAAYYRDHTKNDKVNDLSNRLHSYGPPEALQYPNQHAIAADTEKMEVENSGKMAASVERSAQDAHASGALQEDVVAAYVDNMPACVAGVTLVPQGGRGTIPIRRIDNPTSRQVTFSKRRNGLLKKAYELSVLCDAEVGVMVFSATGRLSEFASTSMQKVLERYQEHSNGAPSRKVLLQDVEFWKREVLFLRDQLFHLKNYENHILGENQIPLDLAEIQRVETRLENALNKIRIQKVQVLHGEMQQIYKQEARLFEENNILRKKLAEATTINGMRGSMSTMTMSHEDLPGSTNQSYGTKALQGGCPSDTSTTTSNDPNHHSSHPPSHPSASQPLTLHLTSPCSPKLDLRL

SEQ ID NO: 3985 - protein, 446 aa, Triticum aestivum
  unsure (1)..(446): unsure at all Xaa locations
MAAHAALAATRIPTSARLHSKAASRQRVDFADFSGLRPGSCSVSAAAREASFSDVLGAQLVARASGENAVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVXDGPGAGKHLQAGAXKKVIITAPAKGADIPTYVVGVNEGDYDHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 3986 - protein, 212 aa, Brassica oleracea var. acephala
VTLLLAAAVCTHGREQVKDSNGNPVKRGAKYFIQPAKSNGGGLVPAAINILPFCPLGITQTLLPYQPGLPVSFGYEPVIIGTDYIYTSTTINIEFRSEIWPVCNELSKLWAVDVSSSAAKEPAIIIGGERTAPNSLFKIEEATGAHTYKLTTSSGTVGTIPGPWLGAPQLIATNDDAKTLFVKFVKVDDDATKATTSTSRVEKLGLRMFPFY

SEQ ID NO: 3987 - protein, 208 aa, Streptococcus pyogenes MGAS8232
MFKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 3988 - protein, 276 aa, Arabidopsis thaliana
QNLKPGSSKWDEVKADVLKALEDYGCFEAFFDKLSVELNRSVFEAMEDLFELPIPTKQRNVSSKPFHGYLCHNLYESLGIDDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYT

SEQ ID NO: 3989 - protein, 86 aa, Zea mays
  unsure (1)..(86): unsure at all Xaa locations
MDPTKFRPASRHHTTETTTNAGAPVXNDNEALTVGPRGPCCSWDYHLIEEEGHFPRDRILEGGEDALDSLLQGDWRWEARPQCCFC

SEQ ID NO: 3990 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 3991 - protein, 127 aa, Oryza sativa
  unsure (1)..(127): unsure at all Xaa locations
DARAAPRGPILXLEDYHLVEKLVNFDRKRIPERVEHAQMGSSKGFFQVTHDITHLNWAEFLRAPGVQTPVIVRFFTRIHDRGRPETLPKHCGLNIKVYTREGKLDLVGNNFPVLFIHDGMKFPDMVH

SEQ ID NO: 3992 - protein, 88 aa, Zea mays
MGFQISKAVIPAAGLGTRFLPATKAMPKEMLPVVDKPAIQYVVEEAVGAGLTDVLMITGRNKNALENHFDHVSELEETLKKKGDHEKL

SEQ ID NO: 3993 - protein, 490 aa, Aspergillus oryzae
MVGIGPKRPPSRKGSMHELPQNLLEQIKQFEDIFTVDGAKLKQIADHFVKELEKGLSVEGGNIPMNVTWVMGFPDGDEQGTFLALDMGGTNLRVCEITLTEEKGAFDITQSKYRMPEELKTGTAEELWEYIADCLQQFIESHHENEKLSKLPLGFTFSYPATQEYIDHGVLQRWTKGFDIDGVEGQDVVPPLEAILKKRGLPIKVAALINDTTGTLIASSYTDSDMKIGCIFGTGVNAAYMEHCGSVPKLAHKNLPPDMPVAINCEYGAFDNEHVVLPLTKYDIIIDRDSPRPGQQAFEKMTAGLYLGEIFRLALLDLLETRPGLIFQGQDTSQLRKPYLLDASFLAAIEDDPYENLQETQELMERKLNIKATQQELEMIRRLAELIGTRAARLSACGVAAICKKKNIESCHVGADGSVFTKYPHFKARGAQALREILDWAPNEKDKVVIMAAEDGSGVGAALIAALTLKRVKAGISCGIRDMADMQSLI

SEQ ID NO: 3994 - protein, 148 aa, Oryza sativa
  unsure (1)..(148): unsure at all Xaa locations
MFAEENGLKGDPRLQAISQAIRVVPHFPIHGIMFQDITTLLLDHKAFKDTVDIFVDRYRDTHISVVAGIEARGFMFGPSIALGIGAKFVPLRKPXGSLPGEEIQKKKALKNGPDGWKWKVGAANPGNRPLTMENWVATGGTMSAGVKL

SEQ ID NO: 3995 - protein, 216 aa, Dendrobium sp. XMW-2002-8
MGRSPCCEKAHTNKGAWTKEEDERLVAYIKVHGEGCWRSLPKAAGLLRCGKSCRLRWINYLRPDLKRGNFTEEEDELIIKLHSLLGNKWSLIAGRLQGRTDNEIKNYWNTHIRRKLLSRGIDPTTHRPLHGQADASFVNEVEKVVSFRRREDENKSSNSSSSNSRSNSEEAKRWRCPDLNLELCISPPLQKQEDSEEDMMREEFGLCFTNGLLEFR

SEQ ID NO: 3996 - protein, 349 aa, Schizosaccharomyces pombe
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 3997 - protein, 262 aa, Triticum aestivum
EFGTSEDNKASMMSSGAVPRVDHVLNNGSMEARKNAAATLFSLSVVDEYKVMIGGTGAIPALVVLLSEGSQRSKKDAATALFNLCIYQGNKRRAIRAGLVPLIMGLVTNPTGALMDEAMAILSILSSHQEGKAAIGAAEPVPALVELLGSGSPRNRENAAAVMLHLCSGEQQLVHLARAHECGIMVPLRELALNGTERGKRKAVQLLERMSRFMVQQQEEQESNSRLQAAVAQVLPQAPEQVQEREIPDQLESPASQYPTLL

SEQ ID NO: 3998 - protein, 419 aa, Grateloupia lanceolata
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALEAIVIARNEGIDYVAEGPQILQDAAKTC

SEQ ID NO: 3999 - protein, 152 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLP

SEQ ID NO: 4000 - protein, 246 aa, Cucumis sativus
MGRGRVELKRIENKINRQVTFAKRRNGLLKKAYELSVLCDAEVALIIFSNRGKLYEFCSTSNMLKTLERYQKCSYGAVEVTKPAKELESSYREYLKLKSRFESLQRTQRNLLGEDLGPLNSKELEQLERQLVSSLKQVRSTKTQYMLDQLSDLQNKEQMLIETNRALQIKLEEISSRNNIRLTWDGGDQSMSYGPQNAQTQGFFQPLECNPTLQIGYTSAVSDQITSTTTPTHAQQVNGFLPGWML

SEQ ID NO: 4001 - protein, 319 aa, Prochlorococcus marinus str. MIT 9313
MLSIRHWLLMVLPFALWGTAMAAMTPLVISGGPLLVACLRLLPAGVVILLALPSLGRDWAIASTDRIWFLVFTVVDACLFQMFLVKGLAYTGAGMGSVLIDSQPLLVALLARSLFGESINPVGWMGLMFGLVGIICLGAPPDLLRHWWLLGEQASGSSLLEQGEGWMLAAAIAMALGTVLSRYACRSSDPVAVTGWHMVLGSLPLLLWHSFDRTWPLWPDWTGFDWGLMAYASLFGSALAYGLFFWLVNREELTSFSTLAFLTPVFALAAGGVWLGERLQPLQWFGVALVLLSVLVVSQRRRLWEPVEVDSDVLPGEIG

SEQ ID NO: 4002 - protein, 351 aa, Streptomyces lavendulae
MTVEQTPENPGTAARAAAEETVNDILQGAWKARAIHVAVELGVPELLQEGPRTATALAEATGAHEQTLRRLLRLLATVGVFDDLGHDDLFAQNALSAVLLPDPASPVATDARFQAAPWHWRAWEQLTHSVRTGEASFPSTWPTAPRSGSSPTRDPKARELFNRAMGSVSLTEAGQVAAAYDFSGAATAVDIGGGRGSLMAAVLDAFPGLRGTLLERPPVAEEARELLTGRGLADRCEILPGDFFETIPDGADVYLIKHVLHDWDDDDVVRILRRIATAMKPDSRLLVIDNLIDERPAASTLFVDLLLLVLVGGAERSESEFAALLEKSGLRVERSLPCGAGPVRIVEIRRA

SEQ ID NO: 4003 - protein, 257 aa, Zea mays
  unsure (1)..(257): unsure at all Xaa locations
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRQVDSTFELYLRNKRNLLGEDLGSLGVKELEQLEKQLDSSLRHIRSTRTQHMLDQLTDLQRREQMLCEAISAFRXKLEETSNQVHGQVWEHGANLLGYERHSPQQQAPSHVGNGLFFHPLEAAAEPTLQIGFAPEHMNNFMPTWLP

SEQ ID NO: 4004 - protein, 52 aa, Glycine max
SQHPYVYELVCFTLYRLHMERELLRVDANRIRRQMHEVVLGNYRSFIAVVDA

SEQ ID NO: 4005 - protein, 301 aa, Methanosarcina mazei Goe1
MTFMEFEKLRHGTELIKRGFARMQKGGVIMDVTTPEQARIAEEAGAVAVMALQAVPADLRKAGGVARMADPEIVQQIIDTVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPAKLAEISKGVGAGMKGISADMIPVQEALQERGW

SEQ ID NO: 4006 - protein, 667 aa, Rhodospirillum rubrum
MIARSIAASSAACHGPAATPRPFPCPTAASMPIPSPSACATSPISTPPWPRRGACSSPAAVSCAWNSARWWCRSLTSFTTFIPSRCCRSWAATSPVTRKPIAIWPRASASSRPRKNFWRAWKPPALVRSAIGTCRAASPPCIRDGASDMIGHLRNLTRLITIARVLARHDALFPLERLGVAKPAVWIAKAASRRNVPGRPGEKLAAAFGELGPSFIKLGQALSTRADLMGEEVAADLSNLQDSLPPFPFEDVRRTVETELDRPLESAFSVFDPVPVAAASIAQVHFAITAPDAEGHTREVAVKVLRPGVEEAFRRDIDLLFWLSRLVEFAQPQWRRLRPVENARAFEESVVIEMDLRFEAAAACELAENFADDPTFRVPAIDWQRTGRRIMTQERVRGLRIDEPDKLIAAGLDPRVLVGNAANAFFSMVFRDGFFHADLHPGNMFVDAEGVLVAVDFGIMGRIDRQTRRYLGEMLLGFLTGNYRRAAEVHFEAGWVPADKSVEGFTQACRSIAEPIMGRPLNEISVARLLGQLFQVTETFDMQAQPQLLLLQKSMLVTEGVGRTLAPDVNMWELSRPLIESWMADNLGPQARLADGMKTLSDSVGRLPRLLESAENLLGGMDKGGFRLHPETVKALRGNRGPLSGVITVAPWLIAIVLGVLLFLKES

SEQ ID NO: 4007 - protein, 464 aa, Hymenena fryeana
KMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLLPYLDVNLPQGIFFQQDWAALRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVETPTANV

SEQ ID NO: 4008 - protein, 434 aa, Heliobacillus mobilis
MEGFCVSVIAEVYAREILDSRGNPTVEVEVVLEDGTVGRAAVPSGASTGAYEAVELRDGDKERYLGKGVLNAVDNVNTEIAPEIIGWDVTRQMEIDSALIELDGTPNKGRLGANAILGVSMACAKAAAQYQGLPLFQYLGGVFARELPVPMMNILNGGKHADNNVDIQEFMVMPVGAQSFSEGLRMGVEVFHSLKKVLQSKGLNTAVGDEGGFAPNLKSNEEALKVILEAVQAAGYKAGEDILLAVDAAASEMYKDGKYHLEGEGKVMTSAEMVDFWEDLVNRYPIISIEDGLNEDDWDGWKLLTDRLGKRAQLVGDDLFVTNTEKLSKGIETGVGNSILIKVNQIGTITETLAAIEMARRAGYTAVISHRSGETEDATIADLAVAVNAGQIKTGAPSRTDRVAKYNQLLRIEEELDEQATYRGKKTFFNLERR

SEQ ID NO: 4009 - protein, 585 aa, Oryza sativa
MVEAGEIGGAAVFALAAAAALSAASSLGAVDFRRPLAAVGGGGAFEWDGVVPWLIGVLGGGDEAAAGGVSVGVAAWYEVWVRVRGGVIAPTLQVAVWVCMVMSVMLVVEATFNSAVSLGVKAIGWRPEWRFKWEPLAGADEEKGRGEYPMVMVQIPMYNELEVYKLSIGAACELKWPKDKLIVQVLDDSTDPFIKNLVELECESWASKGVNIKYVTRSSRKGFKAGALKKGMECDYTKQCEYIAIFDADFQPEPNFLLRTVPFLMHNPNVALVQARWAFVNDTTSLLTRVQKMFFDYHFKVEQEAGSATFAFFSFNGTAGVWRTTAINEAGGWKDRTTVEDMDLAVRASLNGWKFIYVGDIRVKSELPSTYGAYCRQQFRWACGGANLFRKIAMDVLVAKDISLLKKFYMLYSFFLVRRVVAPMVACVLYNIIVPLSVMIPELFIPIWGVAYIPMALLIITTIRNPRNLHIMPFWILFESVMTVLRMRAALTGLMELSGFNKWTVTKKIGSSVEDTQVPLLPKTRKRLRDRINLPEIGFSVFLIFCASYNLIFHGKTSYYFNLYLQGLAFLLLGFNFTGNFACCQ

SEQ ID NO: 4010 - protein, 470 aa, Microbulbifer degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 4011 - protein, 360 aa, Arabidopsis thaliana
MGSNEEGNPTNNSDKPSQAAAPDQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 4012 - protein, 107 aa, Gossypium barbadense
QTKAIAGKVTNWDNVVLAYEPVWAIGTGKVATPAQAQEVHCELRKWLHENVGGDIAASTRIIYGGSVNGANCKELAAQPDVDGFLVGGASLKPEFVDIIKAAMVKKN

SEQ ID NO: 4013 - protein, 174 aa, Glycine max
  unsure (1)..(174): unsure at all Xaa locations
NYKGECIVKRRTAGLEIHTMYNYKTTXELVHYNRNGTYKGIGKPRCVKYXFKTQNIMLSKLGIMLVGWGGNNGSSVNDDVIDNLEGIXGVHMTRTNKSXYLGSLTLSXAILVGSLQGEEIYAPFKRQLPMANPNIHGLGGLDIIYITLANVIVNANVVDIVMHKLLRPNVGHML

SEQ ID NO: 4014 - protein, 317 aa, Beta vulgaris
MGGHISKQVEKRKSISTEKKTLVDLKESCGCDFPGADYHPSDRKNWMAGLDLGKLTINKIVWPGTHDSATNKIGIPFISRPFAQCQSLSIYEQLVKGARVLDIRVQEDRRVCHGILKTYSVDVVLDEVEKFLSETKSEIIILEIRTEFGHDDPPDFDKFLIEKLGDHLIHQDDHVFDKTVSEVLPKRVICVWKPRKSAAPKKGGRFRSAGYLKDNWIDTDLPSTKFESNLNHLADQPPVSSRKFFYRVENTVTPQPDNPILCVRPVTDRIHGYARLFIKQCCERNIADRLQIFSTDFIDADFVNACVGITKARIENI

SEQ ID NO: 4015 - protein, 220 aa, Streptococcus pyogenes M1 GAS
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALNV

SEQ ID NO: 4016 - protein, 537 aa, Pichia angusta
MSILALVATSIGSAQAAAIKKDTAGQHPLGMNSNFGDVFVEKGKSLLDRVSEVVSESSKNISPELRDIWNEMEAKFPDTLRNMKLKSEPAVKITKKPADFWDFNVLNEKFSNYKLRVKKTDPGALGLDHTRQYSGYLDVEDEDKHFFYWMFESRNDPVNDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKVGAEVDTYESCNFDVNRNFLFAGDWMKPYHKNVINLLEQGLPVLIYAGDKDFICNWLGNQAWSNELPWSGHDEFESAELYNLTLKDGTKVGEVKNAGKFTFARMFDGGHMVPYDQPESSLAMVNRWIAGDYSLGTKK

SEQ ID NO: 4017 - protein, 473 aa, Bambusa oldhamii
MAAAVAAADEKLEKLRDAVAQLDQISENEKAGFTSLVSRYLSGEAEQIEWSKIQTPTDEVVVPYDTLAPAPEDLDATKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARANPANPSIELGPEFKKVANFLARFKSIPSIVELDSMKVSGDVWFGSGITLKGKVTISAKSGVKLEIPDGTVLENKDINGPEDL

SEQ ID NO: 4018 - protein, 93 aa, Triticum aestivum
  unsure (1)..(93): unsure at all Xaa locations
MAATIHSEKARQIFDSRGNPTVXVDECCSYGTLARAAVPSGASTGVYEALELTDRGSDYLGKGVSKAVNHVNFIIAPAVVGEDPTAQTELYNF

SEQ ID NO: 4019 - protein, 88 aa, Haemophilus somnus 2336
MNPGFGGQAFIPSTLEKLKQARKIIDESGLDIRLEVDGGVKVNNIAEIAQAGADMFVAGSAIFDQPDYKKVIDEMRQQLSTIREKETK

SEQ ID NO: 4020 - protein, 353 aa, Zymomonas mobilis
MAKATQDSNRPHKADVGSAIPNHDLPPIPGRYHADREELLEFYRRMLMIRRFEERCGQLYGLGLIAGFNHLYIGQEAVAVGLQAALQPGRDSVITGYREHGHMLAYGIDPKIVMAELTGRASGISHGKGGSMHMFSTEHKFFGGNGIVGAQVPLGAGLAFAHKYRNDGGCSAAYFGDGSANQGQVYEAYNMAALWKLPVIFVIENNGYAMGTSIQRANAHTALSERGAGFGIPALVVDGMDVLEVRGAATVAVDWVQAGKGPIILEMKTYRYRGHSMSDPARYRSREEVNDMKENHDPLDNLKKDLFAGVPEAELVKLDEDIRQQVKEAADFAEKAPLPADEELYTNILVGKY

SEQ ID NO: 4021 - protein, 191 aa, Saccharomyces cerevisiae
EFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILAVDYVVKAVSDRVKFLRELSPLWEMVQEGIDINSFKWSGH

SEQ ID NO: 4022 - protein, 494 aa, Bacillus anthracis str. Ames
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 4023 - protein, 355 aa, Phytophthora infestans
MGLCASQMNDNDRQAMAKSREIEAKNEEAHRVEQEKVKLLLLGAGESGKSTVFKQMKILFGAALTEDEKRHCTPIIYNNVVTSMKMLIEQCAEMKLKGDVVCVQDFEDIRTLSDEAEVNLVIGQKIKNLWSDPGIVATWNRRAEFQIIESVKYYFNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVEVFKDFPGGIGDYELGVQYFLGKFMEMNRQPEKEIYHHVTCATDSQNVQVVFNACKDIILKQNIKGSGFM

SEQ ID NO: 4024 - protein, 64 aa, Pectobacterium carotovorum subsp. carotovorum
MSIVNKKVKKAVIPVAGLGTRMLPATKAIPKEMLPLVDKPLIQYVVNECIAAGINEIILVTHSS

SEQ ID NO: 4025 - protein, 772 aa, Glycine max
MGSIFSPLTTIFLLLLLVLWGGEARDPFACDPKNTATKNLPFCKASLATGARVKDLIGRLTLQEKVNLLVNNAAAVPRLGIKGYEWWSEALHGVSNVGPGTKFGGQFPAATSFPQVITTAASFNASLWEAIGRVASDEARAMYNGGTAGLTYWSPNVNIFRDPRWGRGQETPGEDPILAGKYAASYVRGLQGTDGNRLKVAASCKHFTAYDLDNWNGVDRFHFNAQVSKQDIEDTFNVPFRMCVKEGKVASVMCSYNQVNGVPTCADPILLKRTVRGQWGLNGYIVSDCDSVGVFYNSQHYTSTPEEAAADAIKAGLDLDCGPFLGQHTQNAVKKGLISEADVNGALLNTLTVQMRLGMYDGEPSSHPYNNLGPRDVCTQSHQELALEAARQGIVLLKNKGPSLPLSTRRGRTVAVIGPNSNVTFTMIGNYAGIACGYTSPLQGIGTYTKTIYEHGCANVACTDDKQFGRAINAAQQADATVLVMGLDQSIEAETVDRASLLLPGHQQDLVSKVAAASKGPTILVIMSGGPVDITFAKNNPRIVGILWAGYPGQAGGAAIADILFGTANPGGKLPVTWYPEEYLTKLPMTNMAMRATKSAGYPGRTYRFYNGPVVYPFGHGLTYTHFVHTLASAPTVVSVPLNGHRRANGSNIANRAIKVTHARCGKLSINLHVDVKNVGSKDGIHTLLVFSAPPAGNGHWAPHKQLVAFEKVHIPAKAQQRVRVKIHVCKLLSVVDRSGTRRIPMGLHSLHIGDVKHSVSLQAETLGIIKS

SEQ ID NO: 4026 - protein, 160 aa, Xylella fastidiosa 9a5c
MNVVRYTPWPGQAALQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLSIFIPKRAATTPRRIQVGNAVSNDVALQSM

SEQ ID NO: 4027 - protein, 256 aa, Pantoea endophytica
GAAGGIGQALALLLKTQLPSGSELSLYDIAPVTPGVAVDLSHIPTAVKIKGFSGEDARPALQGADVVLISAGVARKPGMDRSDLFNVNAGIVKNLVQQIAEVCPKACIGIITNPVNTTGSIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVPALQGEKGVVECAYVEGDGQYAR

SEQ ID NO: 4028 - protein, 506 aa, Lolium rigidum
MNDDLVYVCSALAVSILAIAVVQLLKARQRLPPGPLNLPVIGSAHRLVNALPHRAMRDLAGVHGPLMYLRVGQVPLVVVTSKEVAREVLKTHDAIFATRPKLMAGDIVAYGSTDLLFCSTPGDYFRKLRRLCVQEILSNDRIRSYQDIREDEVRSLVEDIRAAGPSAPVDLSRKIYKLTNGIVSRAAFGMKSSKAEDFVAAIKHSFVYSTGFSIADLFPGFTGILSFLTGQRRTLEGVRDTIDGILEEIINEREQILKSGRSTASEKNLVEVLLGLQGNEDFGFPITRSTVKAVILDIFAGGTETSGTSMEWAMSELMANPKVMGKLQGEIRAAFGDKEFISEADLRASGGVMKYLGLVIKETFRLHPPAPILVPRESTEACEINGYVIPAKTRVVINSWAIMRDPRYWEDAEEFRPERFEGGRMDFLGGNFEYTPFGSGRRMCPGYNYGMASMELTLVQLLHSFDWSLPDGVDQLDMTEIVSLSLTRKTHLMLRAAPHRAPLPSS

SEQ ID NO: 4029 - protein, 503 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMVERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGKGGIDNYLSIKQVTEYTSDAPWGWYKAPAN

SEQ ID NO: 4030 - protein, 460 aa, Xylella fastidiosa Ann-1
MQPVGAVRRRGGRSSGGAIGKHAICGRQVNAGPLYRGMVWGAVRWADVWWMLRSMGRYSDAHSVDFAFFYVLTRDKSFMQVTSKLPQVGTTIFSVMSQLEDVYGAVNLGQGFPDFPVPLRLQEALEGAVREGHNQYPPMIGVAVLRQGIAVKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALATLLDGTDILLISDEVYEHIVFDGCGHESVLRWPQLRARAFVISSFGKTYHCTGWKIGYAIAPPALSAEFRKVHQYNTFTSFGPAQYAFAAMLHEEPGYVDQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 4031 - protein, 306 aa, Clostridium perfringens str. 13
MNKKIRKAIIPAAGLGTRFLPATKAQPKEMLPIVDKPTIQYIIEEAIASGIEEILIITGRSKKCIEDHFDKSVELEMELEKSGKNELLDLVRDISDMVDIHYIRQKEPRGLGHAIHCAKTFVGDEPFAILLGDDVVYNEEKPCLKQLIDCYNEYKTSVLGVQTVPESHVSKYGIVDGKHIEGKVYKVKGLVEKPSVEEAPSNVAILGRYIVTPRIFDILEKTKPGKGGEIQLTDALLELMGQEAMYAYDFEGRRYDVGDKLGFLEATVEYALRRPELREGFVEYLNNLSEKESLFKKEVEKEIVTV

SEQ ID NO: 4032 - protein, 250 aa, Pichia angusta
MPAASKNVVMIDNYDSFTWNLYEYLCQEGANVEVFRNDQITIPEIEQLKPDVVVISPGPGHPRTDSGISRDVISHFKGKIPVFGVCMGQQCIFEEFGGDVEYAGEIVHGKTSTVKHDNKGMFKNVPQDVAVTRYHSLAGTLKSLPDCLEITARTDNGIIMGVRHKKYTIEGVQFHPESILTEEGHLMIQNILNVSGGYWEENANGAAQRKESILEKIYAQRRKDYEFEMNRPGRRFADLELYLSMGLHRR

SEQ ID NO: 4033 - protein, 442 aa, Methanothermobacter thermautotrophicus str. Delta H
MSDKIGRIIAKMDECGVKFVRLQFVDIHGKPKNMAIPLVRPDQIEDIIKDGLLFDGSSVEGFVDINESDLVLKPDPDTFSTLPWRPEEKGVCRFICDIYWPDGKPFEGDPRYVLKRALDKYAHLGYEYNVGPEPEFFILDQDEDGNIIPHDCGAYFDVEPVDQGTDFRRKLVMDLEALNFDVEVSHHEVAPGQHEIDFKFDKALKTADAVITFKQAIKAIVDKIGYMVTFMPKPFFGENGSGMHCHQSLFKDGENVFYDPDTETQLSEEALYFIGGLLKHAPALTAVCAPTVNSYKRLVPGYEAPVYIAYGLKNRSTLIRIPASRGKGTRVELRMPDPSCNPYLAFAAMLEAGMNGIQNKIDPGEPTEIDVYEKSMSELREMGIETLPSSLWEAYHALEEDDVIKGALGGHVYEKFMEIKHREWDDYRVRVFKYELERYLDI

SEQ ID NO: 4034 - protein, 217 aa, Haemophilus somnus 2336
MDLTKFKEQIEFLDQKVAYFHIDIMDGHYVPNLTLSPFFVSQVKKLATKPLDCHLMVTNPENYIDDLAKAGCDMITLHVETISGQAFRLIEKIRYLEMKVGIIFNPETPIEKAKYYLSKADKVTILTVDPGFAGQSFIPEMLEKVAELKLFRETHQLNYEIEIDGSCNPKTYEMLIKAGADVLIVGSSGLFNNSDNIVEAWDMLEKEIERILSKGML

SEQ ID NO: 4035 - protein, 357 aa, Picea abies
MGSLESEKTVTGYAARDSSGHLSPYTYTLRNKGPEDVIVRVIYCGICHSDLVQMHNEMGMSNYPMVPGHEVVGVVTEIGSEVKKFKVGEHVGVGCIVGSCRSCSNCNGSMEQYCSKRIWTYNDVNHDGTPTQGGFASSMVVDQMFVVRIPENLPLEQAAPLLCAGVTVYSPMKHFGMTEPGKKCGILGLGGVGHMGVKIAKAFGLHVTVISSSDKKKEEALEVLGADAYLVSKDAEKMQEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLVKNDVRYRFVVDVARSNLDK

SEQ ID NO: 4036 - protein, 423 aa, Oryza sativa
  unsure (1)..(423): unsure at all Xaa locations
MAKRRSNGETAAASSDDSSSGVCGGGGGGSGEVEPRRRQKRPRRSAPRDCPSQRSSAFRGVTRCAXWTGRFEAHLWDKNTWNESQSKKGRQGAYLGAYDGEEAAARAYDLAALKYWGHDTVLNFPLSTYDEELKEMEGXSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 4037 - protein, 545 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEVRLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKIVSWRTHLVFPEGARLTPEARDLICRLLCDSEHRLGSHGAGAEQIKAHTWFKDVEWEKLYEMDAAFKPVVNGELDTQNFMKFDEVECPKPARTGSGPSWKVLQFSGKSYIIISLIRGVLLCTYRSTGPLFLLVSITPQNINFVGYTYRNFDAVRGSRHSLDIKGSVSPPRSSTDSTRSKSCY

SEQ ID NO: 4038 - protein, 491 aa, Pseudomonas sp.
MKQYRNFVDGKWVESSKTFQDVTPIDGSVVAVVHEADRDLVDAAVKAGHRALEGEWGRTTAAQRVDWLRRIANEMERRQQDFLDAEMADTGKPLSMAATIDIPRGIANFRNFADILATAPVDSHRLDLPDGAYALNYAARKPLGVVGVISPWNLPLLLLTWKVAPALACGNAVVVKPSEDTPGTATLLAEVMEAVGIPPGVFNLVHGFGPNSAGEFISQHPDISAITFTGESKTGSTIMRAAAEGVKPVSFELGGKNAAVIFADCDFEKMLDGMMRALFLNSGQVCLCSERVYVERPIFDRFCVALAERIKALKVDWPHETDTQMGPLISSKHRDKVLSYFELARQEGATFLAGGGVPRFGDERDNGAWVEPTVIAGLSDDARVVREEIFGPICHVTPFDSESEVIRRANDTRYGLAATIWTTNLSRAHRVSELMRVGISWVNTWFLRDLRTPFGGAGLSGIGREGGMHSLNFYSELTNVCVRIDKESPDV

SEQ ID NO: 4039 - protein, 320 aa, Desulfitobacterium hafniense
ARAAILDSLHALHRYPDPLGGDLKRALAHKHGVDTKQILLGNGSHELLMQLGQVFAGPGEEVVFSRYGFAVFALSTQAAGARMTIVDALPREAAMPCGHDLDAIAAAVGADTKLVYVANPNNPTGTWFGREALVEFLDKIPPQVIVVMDEAYAEMADAPDYASALSVLDRYPNVAVTRTFSKAYGLAGLRVGYLIAQPGLIAVMDRLRESFNVNGPALAACEAALGDDDHLRWACARNAEQRAALAEALNRRGLRAFPSQTNFVLAEFGARTPQVEAALVARGVILRPMGGYGLGDCIRISVGSADENRRLLAALDQVLA

SEQ ID NO: 4040 - protein, 189 aa, Glycine max
  unsure (1)..(189): unsure at all Xaa locations
YLCSLLFCYYCYLGRHLDDTWVAYIGNDFRRMLKWQTVHSGIXSGRFGHTCVEMGDYLVLFGGINDRGNRKNDTWLGHVMFNENNGVTFSWKMLDVGXLHRPSRGAHAACCIDEKRMIIHGGIGLNGLRLGDTWVLEMPDSHCFXTWHEIVXHPSPPPRXGHTLTCIGRTGQSIWRKSLGYEGLDDVCY

SEQ ID NO: 4041 - protein, 462 aa, Thermosynechococcus elongatus BP-1
MVIASVNPTTAEVLKTFSPLGAEEVDRAIAQAATTFETYRLTSFEQRAQWLENTANLLQQQRETLARLMTLEMGKPIAEARAEIDKCAWVCRYYAEQGAAFLEPEFIPTEASYSAIHYQPLGIILAVMPWNFPFWQVFRFAAPALMAGNVALLKHASNVPQCALAIAQIFRQAGFPEGVFQTLLIPGSAVADLVADPRIKAATLTGSEAAGTSLAQAAGQHLKKTVLELGGSDPFIVMPSANISQAIATAVQARMINNGQSCIAAKRFIVHEAVYDTFAEGIKAAFESWVIGDPLEPTTQLGPLATAAIRDELHAQVELALGHGAKAFYRRSLDLPTQCRQGYFFGPTILTEVTPNNPVFTQELFGPVAMLFRVSSLTAAIELANATPFGLGASAWTQDSDEAEILVRDLEAGAVFINAMVKSDPRLPFGGIKTSGYGRELGRAGLLEFVNIKTVCRANTHS

SEQ ID NO: 4042 - protein, 172 aa, Pseudomonas putida KT2440
MRVQLDAVFVPLNIAVLTVSDTRTYDNDTSGALLANRSVEVGHRLVARALLKDDLYKIRAQVASWIADEQVQVVLITGGTGFTGRDSTPEAVECLLDKRIDGFGELFRALSILDIGSSTVQSRALAGLSNRTLVCCLPGSTGACRTAWEGILAEQLDARHRPCNFVKHLLPM

SEQ ID NO: 4043 - protein, 334 aa, Coxiella burnetii RSA 493
MSFNIAINGYGRIGRNILRALYESGKNKDLKIVGINDLGDIKTNAHLTKYDSVHGRFSGEVGVSGNSLVINGDKIEVCAIRNPEELPWRNLEVDLVLECTGLFTSKEKAEAHLKAGAKKVLISAPAGNDVKTIVFGVNENIISSDDEIISNASCTTNCLAPLVKVLNDEIGIERGLMVTVHAYTNDQNLTDSYHKDLHRARAATQSMIPTKTGAAAAVGLVLPELDGKLDGYAIRVPTINVSVIDFTFDAKKLVSASDVNAMMKKAAQGKMKGVLGYNDEPLVSIDFNHDPHSSVFDAGQTRVIDQLVKVVSWYDNEWGFSNRMLDTALAFLKA

SEQ ID NO: 4044 - protein, 459 aa, Betaphycus speciosum
DWDPEYVVKDTDILALFRVSPQPGVDPIEASAAVAGESSTATWTVVWTDLLTACDLYRAKAYKVDAVPNTSDQYFAFIAYDLDLFEEGSIANLTASIIGNVFGFKAVKALRLEDMRIPVAYLKTFQGPATGLVCERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLNVNLPQGIFFEQDWASLRKVTPVASGGIHCGQMHQLLDYLGNDVVLQFGGGTIGHPDGIQAGATANRVALEAMVLARNEDRDYVAEGPQILQDAAKTCGPLQTALDLWKDITFNYTSTDTADFVETPTA

SEQ ID NO: 4045 - protein, 490 aa, Thalassiosira nordenskioeldii
MSQSVSERTRIKSDRYESGVIPYAKMGYWDAAYTVKDTDVLALFRITPQPGVDPVEAAAAVAGESSTATWTVVWTDLLTACERYRAKAYRVDPVPNSPDVYLAFNAYECDLFEEASLSNLTASIIGNVFGFKAVAALRLEDMRIPHSYLKTFQGPATGIVVERERLNKYGTPLLGATVKPKLGLSGKNYGRVVYEGLKGGLDFLKDDENINSQPFMRWRERFLNCLEGINRAAAATGEVKGSYLNITAATMEEVYKRAEYAKAIGSVLVMIDLVMGYTAIQSIAYWARENDMLLHLHRAGNSTYARQKNHGINFRVFCKWMRMSGVDHIHAGTVVGKLEGDPLMIKGFYDILRLTELEVNLPFGVFFEMDWASLRRCMPVASGGIHCGQMHQLIHYLGDDVVLQFGGGTIGHPDGIQAGATANRVALEAMVFSRNEGADFFNNQVGPQILRDAAKTCGPLQTALDLWKDISFNYTSTDTADFAETATANR

SEQ ID NO: 4046 - protein, 242 aa, Glycine max
TSKGVLPDKSVVAVKKIGNIGIQGKKDFCTEIAVIGNIHHVNLVKLKGFCAQGRHRLLVYEYMNRGSLDRNLFGGEPVLEWQERFDVALGTARGLAYLHSGCVQKIIHCDIKPENILLQDQFQAKISDFGLSKLLSAEQSGLFTTMRGTRGYLAPEWLTNSAITEKTDVYSFGMVLLELVSGRKNCYYRSRSHSMDDSNSGGGNSSTSSTTGLVYFPLFALEMHEQRSYLELADSSLRTCHM

SEQ ID NO: 4047 - protein, 513 aa, Triticum aestivum
  unsure (1)..(513): unsure at all Xaa locations
WYFTCAREGSHLSYTSQVISQSRTRVRTRTPLALRSIWSDSIRFDLGFLSKPRDARPELRPWRRTIQSVKARQIFDSRGNPTVEVDVCCSDGTFARXAAVPSGASTGVYEALELRDGGSDYLGKGVSKAVDNVNSIIAPALIGKDPTAQTELDNFMVQQLDGTKNEWGWCKQKLGANAILAVSLAVCKXAGASVKKIPLYQHIANLXAGNKQLVLPVPAFNVINGXGPMLGNKLAMQEFMILPTGAASFKEAMKMGVEVYQQLEXSLLKKKYGQDATNVGDEGGFAPNIQENKXGLELLKTAIEKAGYTGKVVIGMDVAASEFYNDKDKTYDLNFKEENNDGXSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 4048 - protein, 485 aa, Candida albicans
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLTNEEAGALAGSNPDYAQEDLFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 4049 - protein, 104 aa, Triticum aestivum
  unsure (1)..(104): unsure at all Xaa locations
ETIRHFSLLPAGGGGILAHTVARVASSIKIKGDNSGDGIESXXXKXXRLIVDGDLITAADALEQGLHGTEAEEIATEWVKQXRKRAIAEQTLLSFRVAPPTTSP

SEQ ID NO: 4050 - protein, 356 aa, Actinobacillus actinomycetemcomitans
MKKSKLVVALAAILSCAAIPTTVMAESNVQQTMEKSNMSEAKKDLHEIYLAGGCFWGIEAYMERIYGVEDAISGYANGKSDKTNYQKIGITDHAETVKVTYDRNKVSLDKLLKYYFQVIDPTSVNKQGNDRGRQYRTGIYYQDTADKSIIEKEITALQGKYKNKIQIEVEPLHNYIVAEEYHQDYLKKNPNGYCHIDLEQANYVIIDEKDYPKPSDAELKAKLTPLQYSVTQNKNTEHSFSNEYWDNFKPGIYVDVTTGEPLFSSKDKFESGCGWPSFTKPITKEVVTYQDDHSFNMLRTEVISRSGKAHLGHVFDDGPKDKGGLRYCINSAAVKFIPLEDMVKENYGYLTNAVKE

SEQ ID NO: 4051 - protein, 483 aa, Hordeum vulgare subsp. vulgare
  unsure (1)..(483): unsure at all Xaa locations
MERYNIITEVGDGTFGSVWRAINKESGEVVAIKKMKKKYFSWEECINLREVKSLRRMNHPNIVKLKEVIRENDMLFFVFEYMECNLYQLMKSKGKPFSETEIRNWCFQVFQALSHMHQRGYFHRDLKPENLLVTKELIKVADFGLAREIISEPPYTEYVSTRWYRAPEVLLQSSVYSSAVDMWAMGAIIAELFSHRPLFPGSSEADEIYKICNILGTPNQHTWAGGLQLAASIHFQFPQSGSINLSEVVPTASEDALNLISWLCSWDPRKRPTAVEVLQHPFFQPCFYVPPSLRYRSTGYATPPPSVGAKGAMDQKNARRYPVGTLSNGRPAVNNSYLSTNAPARAAGVQRKLELDHQVKPEGNHKLTTKENAMNQPWSRLPPAPVRNNMNYLAAXEQIPRGGAPDIAEKLSQLSMSSTTNRAPIMPSDRFVDLKATTRAHGEPVRRPVPLGPRDTWHARNDPFRRTYEMPGERALLQRKLVS

SEQ ID NO: 4052 - protein, 380 aa, Bradyrhizobium sp. WM9
MSALNCSLVHKGRTPLDTKLRDLLSSLSPVARELGALPSGRPTTDNGCVKLNTNENPFPLPAVVMRSAVQALELQYLYPEDDNISLREAAAAAFGIATDRVIAGNGSSELLGLIYRAFLAPGEGIAMMSPGFSFNRKLAMLQGARFIEIPWSEPDRLPTDELLFGAAKDAKFILLANPNNPTGTFVPLAEIERLAIRSDRLIVLDEAYVDFAPEDGLRLVERHSNLLVLRTFSKSYSAAGIRIGFGFGHPELIGRLRNIQNVFNMNVVAQAVGMSVLAHRDAYEENHRHVRLERQRVAAALSEFGFSVTPSHANFLLARVPVGQGGRWWQAALEDQKVLVAFFPDAGLEECIRVSVGTKRQMDAFLAAVGSILRKVGCRG

SEQ ID NO: 4053 - protein, 300 aa, Triticum aestivum
KNNNKFIIDFLMGGVSAAVSKTAAAPIERIKLLIQNQDEMIKQGRLSTPYKGIGDCFARTMKDEGAISLWRGNTANVIRYFPTQALNFAFKDKFKRMFNKDKNRDGYWAWFAGNLASGGAAGAASLFFVYSLDYARTRLANDAKSAKKGGERQFNGLVDVYKKTLKSDGIAGLYRGFNISCVGIIVYRGLYFGMYDSIKPLMPQNLQDSFLATFALGWAVTTGSGLASYPIDTVRRRMMMTSGAAVKYDSSLHCFREILANEGAKSLFKGAGANILRAIAGAGVLSGYDYLQVWMFGKKY

SEQ ID NO: 4054 - protein, 238 aa, Paenibacillus polymyxa
MMKKKSWFTLMITGVISLFFSVSAFAGNVFWEPLSYFNSSTWQKADGYSNGQMFNCTWRANNVNFTNDGKLKLSLTSPANNKFDCGEYRSTNNYGYGLYEVSMKPAKNTGIVSSFFTYTGPSHGTQWDEIDIEFLGKDTTKVQFNYYTNGVGGHEKIINLGFDASTSFHTYAFDWQPGYIKWYVDGVLKHTATTNIPSTPGKIMMNLWNGTGVDSWLGSYNGANPLYAEYDWVKYTSN

SEQ ID NO: 4055 - protein, 210 aa, Candida albicans
MSGKGTSSRAYDMIMKLLLVGDSGVGKSCLLLRFVEDKFNPSFITTIGIDFKIRTIESKGKRIKLQVWDTAGQERFRTITTAYYRGAMGIVLIYDVTDSRSFENVENWFQTVTQHANEDAQIFLVGNKCDDEVNRQVSKEQGQELAAKLNVPFLEASAKSNENVDSIFYELASIIQEKHVEENIGGVGGASGAGGIDVSQNNSGAKNNCC

SEQ ID NO: 4056 - protein, 491 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPPLAGRAGC

SEQ ID NO: 4057 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQALADLSSQE

SEQ ID NO: 4058 - protein, 553 aa, Oryza sativa
  unsure (1)..(553): unsure at all Xaa locations
MAPIGVLTALDQARTQYYHFKAIVIAGMGLFTDSYDLFCIAPVMKIVGRVYYSDGGARPGVTPPAVVSATVGVALLGAVIGNVVFGALGDRVGRRRVYGACLLLMVCXLRRERLLRVPDAPVRARQPLLLPXFLLGVGVGGDYPLSATIMSEFANRRTRGAFIAAVFSMQGFGILASSAVTMAVAAAFDHYTGYPAPLDTPECADLAWRIILMAGAVPAALTYYWRMSMPETARYTALVERDVVKATNDIGRVLADLDLGAVAEEEVAAALSRPPPPPRPSYGLLSRRFVRQHGRDLFACAAAWFLLDIPYYSSTLFQSQIYRPLFPAPGLINAFQEAFNVAKFQAVIAVASTIPGYFVAVLLIDRVGRRCLQMAGFLLMAVFLFALAGPYDGYWRDHGAHAGYIVLYSLTFFSANLGPNTTTFILPAELFPARFRSTCHGLSGAAGKLGALVGSIGFLWASQQKDGAAAGHLPGIGMMYALFVLGGICLLGLALTYVFTPETMMRSLEENESDRAQTQVGDGGSDTEAAKSPASMASSHLSMSPILPARVSV

SEQ ID NO: 4059 - protein, 575 aa, Zea mays
HASATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 4060 - protein, 284 aa, Klebsiella oxytoca
MFIISSKNMLLKAQRLGYAVPAFNIHNLETMQVVVETAAELRSPLILAGTPGTYSYAGTGNVVAIARDLAKIWDLPLAVHLDHHEDLADITRKVQAGIRSVMIDGSHSPFEENVALVKSVVELSHRYDASVEAELGRLGGVEDDLGVDAKDALYTNPEQGREFVARTGIDSLAVVIGTAHGLYAAEPKLGFAALPPISERVDVPLVLHGASKLPDSDIRRAISLGVCKVNVATELKIAFSDALKHYFEENPDANEPRHYMKPAKAAMKDVVRKVIHVCGCEGQL

SEQ ID NO: 4061 - protein, 510 aa, Bradyrhizobium japonicum USDA 110
MRFVSAPARPMPRPFDFALNLIQSGVNNMTFKRPYGAGLAALAVGLFAATAAYAEPTVNKGDNAWMLTSTVLVLLMTIPGLALFYGGLVRSKNMLSVLMQVFYTVCVVTVIWAVYGYSLAFTGGSDFIGGFSKAFMMGVTTDSKAATFSVDANISELIYMCFQMTFAAITPALIVGAFAERMKFSAIALFIPLWVTLIYFPIAHMVWYWPGPDAIQDAAKALAAATDAAAKTAAQAKLDEINADAGWIFKKGAIDFAGGTVVHINAGIAGLVGALLIGKRTGYGKELMAPHSLTMSMIGASLLWVGWFGFNAGSNLEANGGAALAMTNSFVATAAAALSWMFAEWIVKGHPSVLGVISGAVAGLVAVTPAAGFSGVMGAIVLGLVVGVVCLFFCTVVKNAIGYDDSLDVFGVHCIGGIVGALGTGILVNPALGGAGIIDYTAIPPKVADYDFAAQMVSQFWGVCTTLVWSGIGSAILYKVVDVIVGLRANVESEREGLDITEHTERAYNM

SEQ ID NO: 4062 - protein, 642 aa, Nostoc sp. PCC 9229
MVKTPPSQFSPEQYKVDSATEKVEALIQTPPSDTEINLDFLYTRDIEFRQETIYFLVVDRFHDGDPDNSEGANSELYDPTKQDWGKYWGGDLQGVIDKLDYLKNMGVSAIWLTPLFEQVEELFVGNAALHGYWTKDFKRLNPRYIANGENPSLNATQEEKNTTFDRLIAELHKRNMKLILDIVCNHSSPDTSGSKGELYDDGVKIADFNDDVNHWYHHYGDVQNWEDEWQVQNCELAGLATFNENNSDYRQYIKSAIKQWLDRGVDALRVDTVKHMPIWFWQEFTGDISNHKPDVFIFGEWIYSNPSDDRSVEFANHSGMTMLDFGLCVAIRAALAQGSENGFHTIQYIFDQDHRYSGATELVTFIDNHDMPRFQSLNPDPAMLRVAIALIMTSRGIPCIYYGTEQYLHNDTDGGNDQYNRPMMESWDTDTEVYRYIRLLSGLRRLNPAVSMVSHWQKYLTNDVYCYVRRYRDSLCFVALNRGGEVTLPEVETELPDGEHTCVLTRNKYEVKDGKIYDLVLEERGVIVFSHVGERIKGQTIVRAQLNGVQTQPGETIVVIGDCPELGNWDISKAYPLEYINTNTWFAEIPFNESAGKLIAYKYALWREGQSPLRENLVNRRWVIAKEGTVKWRDTWASGRES

SEQ ID NO: 4063 - protein, 295 aa, Bacillus anthracis str. A2012
MTNVTGTERVKRGMAEMQKGGVIMDVINAEQAKIAEEAGAVAIMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPAKFARAIVEATTHYEDYELIASLSKGLGNAMKGIEISTLLPEQRMQERGW

SEQ ID NO: 4064 - protein, 551 aa, Oryza sativa (japonica cultivar-group)
MDMDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKV

SEQ ID NO: 4065 - protein, 175 aa, Triticum aestivum
  unsure (1)..(175): unsure at all Xaa locations
MAPTVMASLATFVAPFQGLKYTAGLPVSRRSSSAGLGSVSNGGRITCMQVWPIEGIKKFETLSYLPPLCTEALLKQVDYLIRSKWVPCLEFSKVGFVFREHNSSPGYYDGRYWTMWKLSMFGCTDATQVLNEVEEVKKEYPDAYVRVIGFDNLRQVXCVSFXRLKAPGXKDPXXG

SEQ ID NO: 4066 - protein, 420 aa, Oryza sativa
MDRASENRRLAAVGKPVPGIGEMGNRRPLRDINNLVGAPSHPSAIAKKPMLEKSGKEEQKPALVVSHRPMLRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLKKQPC

SEQ ID NO: 4067 - protein, 364 aa, Synechococcus sp. PCC 7942
MSADLSAIAMPAAGPPALAKTPLLLAPFFLWGTAMVAMKGTTDHTTPLFLATVRLLPAGILVLLAAAWLGRPQPQGWRAWAWIGLFGLVDGTLFQGFLAEGLTRTGAGIGSVMIDSQPLIVALLAYWLFGERIGLWGWLGLAIGIVGISLLGLPETWLLALGDRLLQGLHIPVQLVGPAIAELWPTDQSWLSALFNNGRWLMLLAALSMAVGTILSRYVSRWADPIAATGWHMIVGAIPLVLGSWSLESQQWQQLGLSDWLALSYATLFGSAIAYGLFFYFAASGSLTSLSALTFLTPVFALLFGNLFLGEKLGMIQWVGVSLSLVSILLISQRDWLTARGWKTRLQPAVIDPALPEVPDRSAQ

SEQ ID NO: 4068 - protein, 606 aa, Bifidobacterium longum DJO10A
MTKPTRTTPESGSTPLSSRVDPILTPAKAEREAAANRSVDTSDTLKQTVTKATPSVSDETLALFGRRNDFATRYHLTRRGKIKRLGQITRIVEQFDVLHGLTPVKMRLMFEALGPTFVKVGQILSMRSEILPQSFCDELAKLRADADPMPYSTVLDVLAAEYGRPADEVFAHIDSKPLGSASLAQVHRATLKTGEDVAIKVQRPGVRETMAQDVSIMRSIAKAATKVIRTSQIVDLKGVVEELWDTFESETDFLIEASNLAEFKRFAARFKYMDCPTVYAELCTEHVVVMEYIDGISVSHPGQLVDAGYDLKEIGTKLVDNYATQILDDGFFHADPHPGNIIIRGGQIVLIDLGMTGRLDQRTRAVLKEMIFAVAKQDSPALAEGLLRFAGTEADPEDYPALLADLDVIVKEFGTVDLAELDIAAFLTALTQMAGRHNIEVPSTVTTVGRALVTLEGLLDEFIPDVNMIEIISDHIATSKSLKNATKDEIKSLGVEGHQALHATLGTMTELKTVARMLTRGQLRVNMELVGSEEPFQLLSDMVNRLTMALIVVGLFVGSSIVYYAGMKPIIFGIPVIGFMGYVVAFALGVWIVIDIYLKGRKTKKR

SEQ ID NO: 4069 - protein, 115 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFVRAPGVQTPVIVRFSTVVHERASPET

SEQ ID NO: 4070 - protein, 305 aa, Oryza sativa
MKRLSFSLFLLPFLLLAFVYSLFFPGYFSILPSLAARCSNSVAATPANATGPAVDLRVLLGVVTRAEMYERRALLRLAYALQPAPARAVVDVRFFVCSLAREEDAVLVSLEIIAHGDVVVLNCTENMDDGKTHSYFSSLPALFADAPYDYVGKIDDDSYYRLASLADTLRDKPRRDLYHGFPAPCHADPRSQFMSGMGYIVSWDVAAWVAATEALRGDVKGPEDEVFGRWLRRGGKGSNRYGEETRMYDYLDGGMREGVNCFRHALVADTVVVHKLKDRLKWARTLKFFNATQGLKPSKLYHVDL

SEQ ID NO: 4071 - protein, 512 aa, Petunia x hybrida
MEILSLILYTVIFSFLLQFILRSFFRKRYPLPLPPGPKPWPIIGNLVHLGPKPHQSTAAMAQTYGPLMYLKMGFVDVVVAASASVAAQFLKTHDANFSSRPPNSGAEHMAYNYQDLVFAPYGPRWRMLRKICSVHLFSTKALDDFRHVRQDEVKTLTRALASAGQKPVKLGQLLNVCTTNALARVMLGKRVFADGSGDVDPQAAEFKSMVVEMMVVAGVFNIGDFIPQLNWLDIQGVAAKMKKLHARFDAFLTDILEEHKGKIFGEMKDLLSTLISLKNDDADNDGGKLTDTEIKALLLNLFVAGTDTSSSTVEWAIAELIRNPKILAQAQQEIDKVVGRDRLVGELDLAQLTYLEAIVKETFRLHPSTPLSLPRIASESCEINGYFIPKGSTLLLNVWAIARDPNAWADPLEFRPERFLPGGEKPKVDVRGNDFEVIPFGAGRRICAGMNLGIRMVQLMIATLIHAFNWDLVSGQLPEMLNMEEAYGLTLQRADPLVVHPRPRLEAQAYIG

SEQ ID NO: 4072 - protein, 104 aa, Glycine max
MALNNGVPATGTGLIVSFGEMLIDFVPTVSGVSLAEAPGFLKAPGGAPANVTIAVTRLGGKAAFVDKLGDDKFGHMLAGILKDFNQDTRTALALVTLHASGERK

SEQ ID NO: 4073 - protein, 279 aa, Pseudomonas putida KT2440
MIKKCLFPAAGYGTRFLPATKAMPKEMLPVVNKPLIQYGVEEALDAGLNEISIVTGRGKRALEDHFDISYELENQIKGTDKEKYLVGIRRLLNECSFSYTRQTEMKGLGHAILTGRPLIGDEPFAVVLADDLCVNPEGDGVLTQMVKLYKQYRCSIVAIQEVDPQETNKYGVIAGEMIRDDIFRVTNMVEKPAPEDAPSNLAIIGRYILTPDIFDIIANTKPGKGGEIQITDALLQQAKDGCVIAYKFKGKRFDCGGAEGYIDATNFCFENYYKTGKAY

SEQ ID NO: 4074 - protein, 335 aa, Agrobacterium tumefaciens str. C58 (Cereon)
MLMEETMRQASVLAPHTNGPTVTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAELDAFMAAQLSEEVL

SEQ ID NO: 4075 - protein, 772 aa, Novosphingobium aromaticivorans
MADAATEARTEGRTVRLQVAGARQEESGHGIARISRHVMSQLGVTEGDVIEIVGKRATAARVIQPYPEDEGLELIRLDGLQRANADVGSGEHVEVRKIDSRPAQRVVFAPAQKDLRLQGPAVALKRNFAGRPLVTGDLVATAGQQQVNRTDMPPQLRQMLNAPAFALTQIRLTVVSTSPKGVVHIDENTEVELRPEYEEPRSSRADVNYDDVGGMGDTIRQLREMVELPLRYPELFTRLGVDPPKGVLLHGPPGTGKTRLARAVANESDASFFTINGPEIMGSAYGESEKRLREVFEEATANSPSIIFIDEIDSIAPKRSEVHGEAEKRLVAQLLTLMDGLHSRSNLVVIAATNRPDAIDEALRRPGRFDREIVVGVPDESGRREILGIHTRGMPLAEDVDLQELARTTHGFVGADLAALAREAAIEAVRRIMPRLDFEQQTIPQDVLDSLRVERDDFLEALKRVQPSAMREVMVQAPTIGWADIGGLDEAQEKLREGVELPLKNPEAFHRLGIRPAKGFLLYGPPGTGKTLLAKAVAKEAEANFIAIKSSDLLSKWYGESEQQIARLFARARQVAPCVVFIDEIDSLVPARGSGQGEPNVTARVVNTILAEMDGLEELQSVVLIGATNRPNLVDPALLRPGRFDELVYVGTPSMSGREHILGIHTRNMPLAPDVDLALVARATDRFTGADLEDVVRRAGLNAIRRGGGNVDQVKASDFDEALEDSRATVTEQMEEEYGRMKGELKKRAMNPGPLGFIVPGMVQPTRESKHG

SEQ ID NO: 4076 - protein, 369 aa, Corynebacterium efficiens YS-314
MVMCCAQRESFPKIVVAAVAGAGGMKTGARSLPDHLHNIRYPGMSSTNISASSQWSISEVLKRPVPGRVPFSVEFMPPRDDAAENRLYRAAEVFHDLGASFVSVTYGAGGSTRERTARVARRLSRQPLTTLVHLTLVDHTIAELQEILRGYAELGLTNLLALRGDPPGDPLGEWATSEGGMSYALELIEMIKNSPEFSHFDIGIASFPEGHYRAGSLENDTRYTLAKLRAGAEYSITQMFFDVEDFLRLRDRLVAADPIHGAKPIIPGLMPITSLRSVRRQVELSGSTLPRALEEKLLRAANGDEEANRNEIRKVGIETTSEMAERLIAEGVPDLHFMTLNFTRATQEVLHNLGMAPAWGAEHGHDAVR

SEQ ID NO: 4077 - protein, 353 aa, Penicillium marneffei
MGCGMSTEDKEGKARNEEIENQLKRDKMMQRNEIKMLLLGAGESGKSTILKQMKLINEGGYSRDERESFKEIIYSNTVQSMRVILEAMESLELPLEDPRAEYHVQTIFMQPSQIEGDSLPPEVGGAIQALWHDAGVQECFRRSREYQLNDSAKYYFDSIERIAQPDYLPSDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGADYAAACDYILNRFVSLNQAEQKQIYTHFTCATDTNQIRFVMAAVNDIIIQENLRLCGLI

SEQ ID NO: 4078 - protein, 340 aa, Mycobacterium tuberculosis H37Rv
MQLGMIGLGRMGANIVRRLAKGGHDCVVYDHDPDAVKAMAGEDRTTGVASLRELSQRLSAPRVVWVMVPAGNITTAVIEELANTLEAGDIVIDGGNTYYRDDLRHEKLLFKKGIHLLDCGTSGGVWGRERGYCLMIGGDGDAFARAEPIFATVAPGVAAAPRTPGRDGEVAPSEQGYLHCGPCGSGHFVKMVHNGIEYGMMASLAEGLNILRNADVGTRVQHGDAETAPLPNPECYQYDFDIPEVAEVWRRGSVIGSWLLDLTAIALRESPDLAEFSGRVSDSGEGRWTAIAAIDEGVPAPVLTTALQSRFASRDLDDFANKALSAMRKQFGGHAEKPAN

SEQ ID NO: 4079 - protein, 163 aa, Synechocystis sp. PCC 6803
MYRNDQISLEEVKSLQPDAIVISPGPGRPDDAGISLQLIEKLSASTPILGVCLGHQSIGQVFGGKVVAAPELMHGKTSQIYHQQQGIFAGLASPVQATRYHSLIVERESLPECLEVTAWLADGMVMAFQHRDYPHVQSVQFHPESILTKEGKQMLENFLQSLG

SEQ ID NO: 4080 - protein, 754 aa, Streptococcus pyogenes MGAS315
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSISSLGINGEGVGLNYHCGLFKQVFKHNEQEAEPNYWIEDDSWLVPTDISYDVPFKNFTLKSRLDRIDVLGYKRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWITKVVHNIAKAGFFSSDRTIEQYNEDIWHSR

SEQ ID NO: 4081 - protein, 197 aa, Syrrhopodon prolifer
GGAKKVVISAPSKDAPMFVMGVNEEKYTSEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKAALKDASEGKLKGILGYTEDDVVSSDFITDSRSSIVDAKAGIALSDTFVKLV

SEQ ID NO: 4082 - protein, 167 aa, Zea mays
MKQTVAALLAKTLESAGVKRIWGVTGDSLNGLNDSLNRMGTIEWMPTRHEEVAAFAAGAEAQISGELAVCAGSCGPGNLHLINGLFDCHRNHVPVLAIAAHIPSSEIGSGYFQETHPQELFRECSHYCELVSNPEQLPQVLGIAMRKAILNRGVSVIVLPGDVALQV

SEQ ID NO: 4083 - protein, 331 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 4084 - protein, 492 aa, GIBBERELLA ZEAE PH-1
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASSNLKKVTLELGGKSPNIVFEDADIEEAINWVNFGIYYNHGQCCCAGTRIFVQESIYDKFLAAFKKRAEENKVGDPFNEETFQGPQVSQLQYDRIMGYIKAGKDEGATVEIGGERLGDKGYFIKPTIFSNVRPDMKIMQEEIFGPVCAISKFKDEAEVIDLAHDTAYGLAAAVHTKNLNTALRVSNALKAGTVWVNCYNMLHHQLPFGGYKESGIGRELGEAALANYTQNKSVAIKLY

SEQ ID NO: 4085 - protein, 465 aa, Gelidium tenuifolium
AKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLIKGIFFEQDWASLRKVTPVASGGIHCGQMHQLLDYLGDDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 4086 - protein, 551 aa, Spinacia oleracea
MQASTFMVKGNLGFEVQNRRVAGLAGLKGLSSIRSNNLSFVNVNDNNYKSNPCKLSCGSLSMGAGFARLGLDHVMKSSPKYRSVKAQAASGGDLEDATPVKYQGKSSASVLPYVGVACLGAILFGYHLGVVNGALDYLSADLAIAGNTVLQGWVVSILLAGATVGSFTGGSLADKFGRTKTFQLDAIPLAIGAYLCATAQNVQIMMIGRLLCGIGIGISSALVPLYISEISPTEIRGALGSVNQLFICIGILAALVAGLPLAGNPLWWRTMFGIATVPSVLLALGMGFCPESPRWLFQQGKIVEAEKAVAALYGKERVPEVINDLRASVQGSSEPEAGWFDLFSSRYRKVVSVGAALFLFQQMAGINAVVYYSTSVFRSAGIASDVAASALVGASNVIGTAVASSLMDKQGRKSLLMTSFSGMAASMLLLSLSFTWKALAPYSGTLAVVGTVLYVLSFSLGAGPVPALLLPEIFASRIRAKAVALSLGMHWASNFVIGLYFLSVVTKFGISKVYLGFASVCVLAVLYIAGNVVETKGRSLEEIELALSPAV

SEQ ID NO: 4087 - protein, 104 aa, Oryza sativa
MAKAVALAVLVVAVAAALLAVAPAPARAVCNMSNDEFMKCQPAAAATSNPTTNPSAGCCSALSHADLNCLCSYKNSPWLSIYNIDPNRAMQLPAKCGLTMPANC

SEQ ID NO: 4088 - protein, 98 aa, Glycine max
  unsure (1)..(98): unsure at all Xaa locations
TRAESPLFAPFTVLKTMAGLPTIKTTNYITSIANNGGRVQCMQVCPPVGKKKFDTLSYLPNLDDAQLAKEVQYLLRKGWIPCXEIRXDHGLEYREHNR

SEQ ID NO: 4089 - protein, 79 aa, Glycine max
KEWHAVASWTWDAQDETCGICRMAFDGCCPDCKLPGDDCPLIWGVCNHAFHLHCILKWVNSQTSQAHCPMCRREWQFKG

SEQ ID NO: 4090 - protein, 338 aa, Hordeum vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 4091 - protein, 461 aa, Raphanus sativus
MERRREFQRKVQEAQLPVEEQDEMMRSLARRETEYMRLQRRKIGIDDFELLTVIGKGAFGEVRLCRLRSTGEVYAMKKLKKTDMLSRGQVEHVRSERNLLAEVDSRYIVKLFYSFQDSECLYLIMEYLPGGDIMTLLMREDILSEDVARFYIAESILAIHSIHQHSYVHRDIKPDNLILDKSGHLKLSDFGLCKPLDDKYSSLLLEDEEMLSQEAESQSGKADSDKAPWQMPKEQLLQWKRNRRALAYSTVGTLDYMAPEVLLKKGYGMECDWWSLGAILYEMLVGYPPFCSDDPRITCRKIINWRVCLKFPEEPKISEEARDLICRLLCDVESRLGTRGAEEIKTHPWFNGTQWDKLYEMEAAYRPTVDGELDTQNFEKFPEVEGSASEAPQVGPWRKMLTSKDNNFIGFTFKKSDITRSMENTGTDMKPNGSGDAPSLISLLGRINMEEAEGGELNQKT

SEQ ID NO: 4092 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 4093 - protein, 425 aa, Helicobacter pylori J99
MAYNPKILQKPKEGEEITIKDGKLHVPNYPIIPFIEGDGIGSDITPAMIKVVDSAVQKAYKGEKKIAWYEVFVGEKCYQKFKDHKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVEKIRFPESSGVGIKPISKEGTERLVRKAIEYAIDNDKPSVTFVHKGNIMKYTEGAFMKWGYALAQKEFNAQVIDKGPWCSLKNPKTGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 4094 - protein, 251 aa, ASPERGILLUS NIDULANS FGSC A4
MAYDPRLAGAGTAAQETPAPPSPTEAANRSMEAHLRLSTAASPFPVISFGTGSLVRLPGPSITQPNVYNFNSTSYSQMYDELLSKDERLYRNNGILNMLDRNRNVKWGPERFQDWVPGMPRVDHVSKGDKGALGTEGGVVDVIITCEERCWDAVVDDLLNKGSTLNRPVHVFNVDIKDNHEEALVGGKAILELATRLNEVATQEQKALGSGGWENGTGEARRSFDEKVPEVLGAWQEKWPNLPALWTLAWL

SEQ ID NO: 4095 - protein, 346 aa, Bacteroides thetaiotaomicron VPI-5482
MRVETPSVLLIYTGGTIGMIENPETGALENFNFDHLLKHVPELKRFNYRISSYQFDPPLDSSDMEPAYWAKLVKIINYNYDYFDGFVILHGTDTMAYTASALSFMLENLSKPVILTGSQLPIGTLRTDGKENLITAIEIAAAKNPDGTAIVPEVCIFFENHLMRGNRTTKINAENFNAFRSFNYPPLARVGIHIKYEPNLIRKPDPDKPLKPHYLFDTNVVILTLFPGIQEEIIHSLLHVPGLKAVVMKTFGSGNAPQKEWFIRELKEATDRGIIIVNITQCASGAVEMGRYETGMHLLEAGVISGYDSTPECAVTKLMFLLGHGLSNKDIRYKMNSCLIGEITKP

SEQ ID NO: 4096 - protein, 126 aa, Triticum aestivum
  unsure (1)..(126): unsure at all Xaa locations
ILVITIKTFIVSIVVKGFXXXTNKTSLLVGMSLAQIGEFAFVLLSRASSIHLIEGKLYLLLLGTTALSLVTTPLLFKMIPAVVHLGVLLRWFSVDSNQVELGLKGEVLRIDSGKRINLIIQGPHDS

SEQ ID NO: 4097 - protein, 303 aa, Oryza sativa
MARTMTMRVSSLLVAVVLLAALSFQACSGHGGINDGDGQVDAPATPASSSGVRSKGLIAVKVWCLVILLVFTFAGGVSPYFYRWNESFLLLGTQFAAGVFLGTALMHFLADSTSTFKGLTTNQYPFSFMLTCVGFLLTMLSDLVIAAVARRSAAAGVSDNQVSEQQQRQQAEGAVMSRKEEEAAAVAHPAMLWTIGLHKIFAAVAMGIALLRMIPKRPFLMTVVYSLAFAVSSPVGVGIGIAIDATYAISMGLATGVFIYVAINHLIAKGYRPHHPTAADKPLFKFLAVLLGVAVMAVVMIWD

SEQ ID NO: 4098 - protein, 438 aa, Zea mays
  unsure (1)..(438): unsure at all Xaa locations
MATHAALAASXPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 4099 - protein, 400 aa, Oryza sativa
YPRSPRHKAPAVIAAPSAPSTYTRASGNAVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEFLCCSNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWTWSLLGKLMSAKIRYSLISLIFYSTKL

SEQ ID NO: 4100 - protein, 230 aa, Triticum aestivum
PAWLDGMLDEDEKFFKANGVPLFSSHMIDLSEESKEENIQTSKKYLQRAAPMKQFLEMEIGITGGEEDGVNNEDVDNNSLYTQPEDIYDIYREFSEVSKYFSIAAGFGNVHGVYSPGNVKLRPELLQKHQQFVKEKTNAKDDKPVFLVFHGGSGSSVDDFRQAISYGVVKVNLDTDMQWAYLSGVRDYVLNKKDYLMSQVGNPEGSGKPNKKFYDPRVWVREGEKTMSQR

SEQ ID NO: 4101 - protein, 488 aa, Listeria seeligeri
MTDRRNLTTNQGVPIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEEGKTVYVKLRWVPKAGIVNLSTDQAAQIQAKEFNHASRDLYEAIENGDYPEWDLYVQVLDPKDLDNYDFNPLDATKDWFEDVFPYEHVGTMTLNRNPDNIFAETESVGFNPGVLVPGMLPSEDRVLQGRLFSYSDTQRHRVGPNYLQLPINSPKTPVDNNQRDGQMPFKQQTSSINYEPNSYDTEPKENPAYIEPEQEIRGDISGRLVAEKPNNFGHAKEVWKRYSDAERAALVKNIVDDWEGVREDIKIRNLRNFYQVEPEFAERVAAGTGINLAEHVIDLK

SEQ ID NO: 4102 - protein, 317 aa, Haemophilus influenzae Rd
MTTQLDSLRNMTVVVADTGDIDAIKKYQPQDATTNPSLILSASALPQYAPLIDEAVAYAKAQSADKAQQLIDAEDKLAVNIGLEILKIVPGRISTEVDARLSYDTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALVRKLEYKGEVKAKPQPLTEAEFYWQHNSDAMAVEKLAEGIRKFAIDQEKLETMLSAKL

SEQ ID NO: 4103 - protein, 252 aa, Lactococcus lactis
MSRKPIIAGNWKMNKTLSEAQAFVEAVKNNLPSSDNVESVIGAPALFLAPMAYLRQGSELKLAAENSYFENAGAFTGENSPAAIVDLGIEYIIIGHSERREYFHETDEDINKKAKAIFAAGATPILCCGETLETFEAGKTAEWVSGQIEAGLAGLTAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 4104 - protein, 355 aa, Nectria haematococca mpVI
MSRSNPPNPTGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRAIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 4105 - protein, 199 aa, Triticum aestivum
MAPSRKFFGGGNWKMNGRNQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSD

SEQ ID NO: 4106 - protein, 385 aa, Oceanobacillus iheyensis HTE831
MSECIGMLLAGGEGKRLGMLTKQGAKPAVPFGGKYRIIDFTLSNCTNSGIQTVGILTQYAPLELNKHIGNGKPWDMNHQHGGVSILPPYTGTKGGDWYSGTADAIYQNMNFIHQYEPEYVLIISGDHIYQMDYQQMLEQHKRTNADVTISVIEVPWAEAGRFGILHANDEQIIYEFEEKPKNPSSNLASMGIYIFNWKTLKKYLIEDANKPNSSRDFGKDIIPSMLNNQHRLYAFKFNGYWKDVGTIQSYWEANMDVLKDNNGYFSLHDRNWRIYTHDSNLPPHFIGTNGKAVNSYINSGSIIYGHIKNSIVFRNVSVQQGSYINQSIIHPNVKIGKDCVLDRVIVMENTTIPEGTIFRSDKEIEPFIINNEILNSMLAPAGGDV

SEQ ID NO: 4107 - protein, 485 aa, Candida tropicalis
MAPTFTNSNGQPIPEPFATQRVGQHGPLLLQDFNLIDSLAHFDRERIPERVVHAKGSGAYGVFEVTDDITDVCAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESVHQVMVLFSDRGTPASYREMNGYSGHTYKWSNNKGEWFYVQVHFISDQGIKTLTNEEAGSLAGSNPDYAQEDLFKNIAAGNYPSWTCYIQTMTEAQAKEAEFSVFDLTKVWPHGKYPMRRFGKFTLNENPKNYFAEVEQAAFSPAHTVPHMEPSADPVLQSRLFSYADTHRHRLGTNYTQIPVNCPVTGAVFNPHMRDGAMNVNGNLGNHPNYLASDKPVEFKQFSLQEDQEVWHGAATPFHWKATPADFKQATELWKVLKKYPNQQEHLAHNVAVHASAADAPIQDRVIAYFTKVHPDLGDLIKKEILELSPRK

SEQ ID NO: 4108 - protein, 372 aa, Glycine max
  unsure (1)..(372): unsure at all Xaa locations
MEEQNRFGVYRMKGEFSVDLKLGHHVGNSGTESALANKSKDAAAAGVSKMASSPSGSSKRARAINSTSLTVACLVDGCNSDLSNCRDYHRRHKVCELHSKTPEVTIGGFKQRFCQQCSRFHSLEQFDERKRSCRKRLDGHNRRRRKPQPEPLSRPGSFLSNYQGTQLLPFSSXHVYPSTAIVSPSXWSASLVTSSADARLHNHNQQQHHHHQQDLFLGSSHKEGKQVAFLHNNHPSTAAALSSQTPPPFPSSSVRHTLLRTDPLSETCGGARSKMFCESLTTTTTNNNSVHDTTPCALSLLSSSQTHTPGNGLNQMVQPPPSMSLMQPLGLSLQDNNSLESVDHCSSMYSLASDHGSQCNEAAPQLFPFQWE

SEQ ID NO: 4109 - protein, 258 aa, Streptomyces avermitilis MA-4680
MTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 4110 - protein, 375 aa, Bacillus subtilis subsp. subtilis str. 168
MKKQRMLVLFTALLFVFTGCSHSPETKESPKEKAQTQKVSSASASEKKDLPNIRILATGGTIAGADQSKTSTTEYKAGVVGVESLIEAVPEMKDIANVSGEQIVNVGSTNIDNKILLKLAKRINHLLASDDVDGIVVTHGTDTLEETAYFLNLTVKSDKPVVIVGSMRPSTAISADGPSNLYNAVKVAGAPEAKGKGTLVVLNDRIASARYVTKTNTTTTDTFKSEEMGFVGTIADDIYFNNEITRKHTKDTDFSVSNLDELPQVDIIYGYQNDGSYLFDAAVKAGAKGIVFAGSGNGSLSDAAEKGADSAVKKGVTVVRSTRTGNGVVTPNQDYAEKDLLASNSLNPQKARMLLMLALTKTNDPQKIQAYFNEY

SEQ ID NO: 4111 - protein, 133 aa, Glycine max
RISSHVVTTVNRAGAGLVVPLTGLKSMAGFPTGKTNIAIPSIVGTGGGVHCMQGGPPIGRKKFGTFSYWPDLVDAQLAKEVESFLRKGWIPCLEFGWEHGFGFRGPTSLPGSFDGPLWTMWKLPMLGCTDAFK

SEQ ID NO: 4112 - protein, 537 aa, Neurospora crassa
MTLLALKEDRPTPKAVYNWRVYTCAAIASFASCMIGYDSAFIGTTLALPSFTKEFDFASYTPGALALLQSNIVSVYQAGAFFGCLFAYATSYFLGRRKSLIAFSVVFIIGAAIMLAADGQGRGIDPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLYANGKREEAMKVLCWIRNLEPTDRYIVQEVSFIDADLERYTRQVGNGFWKPFLSLKQRKVQWRFFLGGMLFFWQNGSGINAINYYSPTVFRSIGITGTDTGFLTTGIFGVVKMVLTIIWLLWLVDLVGRRRILFIGAAGGSLCMWFIGAYIKIADPGSNKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFLPVTKSIPLEAMDRLFEIKPVQNANKNLMAELNFDRNPEREESSSLDDKDRVTQTENAV

SEQ ID NO: 4113 - protein, 252 aa, Brevibacillus brevis
MVKSKYLVFISVFSLLFGVFVVGFSHQGVKAEEERPMGTAFYESFDAFDDERWSKAGVWTNGQMFNATWYPEQVTADGLMRLTIAKKTTSARNYKAGELRTNDFYHYGLFEVSMKPAKVEGTVSSFFTYTGEWDWDGDPWDEIDIEFLGKDTTRIQFNYFTNGVGGNEFYYDLGFDASESFNTYAFEWREDSITWYVNGEAVHTATENIPQTPQKIMMNLWPGVGVDGWTGVFDGDNTPVYSYYDWVRYTPL

SEQ ID NO: 4114 - protein, 243 aa, Nostoc punctiforme
MRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFHLV

SEQ ID NO: 4115 - protein, 353 aa, Helicobasidium mompa
MGACFSSEGGGQHDISYAIDRQIEEDARKFKKECKILLLGSGESGKSTIVKQMKIIHQNGYTRDELVLFKATVFKNVVDSAQAIVLALRKFRMDPVEPVNRMYADRIMEYRVDLDMGIGLSQDVVRSIESLWHDPIIPSVLDRGSEFYLMDSAPYFFDDVQRIGSPDYIPNETDVLMARTKTTGISETKFRSGQLSIHMFDVGGQRSERKKWIHCFEAVTSIIFCVALSEYDQVLLEESNQNRMAESLVLFESVINSRWFLRTSIILFLNKIDLFKAKLPKVPLERYFAEYTGGDDVNKAAKYILWRFTQLNRARLSIYPHLTQATDTSNIRLVFAAVKETILQNALRDSGIL

SEQ ID NO: 4116 - protein, 256 aa, Pantoea agglomerans
  unsure (1)..(256): unsure at all Xaa locations
GAAGGIGQALALLLKTQLPAGSELSLYDIAPVTPGVAVDLSHIPTAVAIQGFSGEDATPALQGADVVLISAGVARKPGMDRADLFNVNAGIVRNLIEQVATTAPKALIGVITNPVNTTVAIAAEVLKKHGVYDKNRLFGVTTLDIIRANTFVAALKGKQPDQVEVPVIGGHSGVTILPLLSQVKGVXFSDQEVADLTKRIQNAGTEVVEAKAGGGSATLSMGQAAARFGLSLVRALKGEANVVECAYVEGEGEHAR

SEQ ID NO: 4117 - protein, 485 aa, Grateloupia turuturu
NSVERTRIKNERYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDMNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPLQTALDLWKDITFNYTSTDTADFVETPTTNV

SEQ ID NO: 4118 - protein, 170 aa, Triticum aestivum
  unsure (1)..(170): unsure at all Xaa locations
MAKGKRWRFAMVCSSNMNRSMEAHSQLGRAGLDVESYGTGTHVKLPXPSLHEPNVYDFXTPYXAIYDDLRRKDPXLYKRNGLLPMLKRNTXGELAPQXVGKTMXXTGCFDMIMXXAERXFDXVXXNIXNRXRGYECVLIINMIQRYNWCWNLRKFAKTLTIDTGRILLIR

SEQ ID NO: 4119 - protein, 607 aa, Arabidopsis thaliana
MDTKIGSIDACNPTNHDIGGPPNGGVSTVQNTSPLHSTTVSPCDATLGRYLARRLVEIGVTDVFSVPGDFNLTLLDHLIAEPNLKLIGCCNELNAGYAADGYARSRGVGACVVTFTVGGLSVLNAIAGAYSENLPLICIVGGPNSNDYGTNRILHHTIGLPDFTQELRCFQAVTCFQAVINNLEEAHELIDTAISTALKESKPVYISISCNLPAIPLPTFSRHPVPFMLPMKVSNQIGLDAAVEAAAEFLNKAVKPVLVGGPKMRVAKAADAFVELADASGYGLAVMPSAKGQVPEHHKHFIGTYWGAVSTAFCAEIVESADAYLFAGPIFNDYSSVGYSLLLKKEKAIIVQPDRVTIGNGPAFGCVLMKDFLSELAKRIKHNNTSYENYHRIYVPEGKPLRDNPNESLRVNVLFQHIQNMLSSESAVLAETGDSWFNCQKLKLPEGCGYEFQMQYGSIGWSVGATLGYAQAMPNRRVIACIGDGSFQVTAQDVSTMIRCGQKTIIFLINNGGYTIEVEIHDGPYNVIKNWNYTAFVEAIHNGEGKCWTAKVRCEEELVKAINTATNEEKESFCFIEVIVHKDDTSKELLEWGSRVSAANSRPPNPQ

SEQ ID NO: 4120 - protein, 579 aa, Chlamydomonas reinhardtii
MASPAPSGSPPLVIYSCTDEQMLEVTELVGDSATAAIVCSQYDCSFTAVSCVLKYLAAQQADLSEQMDGTAKAEVALSLDVAFLLFSAYLVFGPMQLGFALLCAGAIRSKNSMNVLMKNILDACTGAIGFYLFGYAFAFGHHANQTSNAFIGDHNFALSYTTQVSSLDSNVSYDGFATQGWHVFFFQWSFCAAATTIVSGAVAERCTFQAYLAYAFFISSFVYPVVVHWVWSASGWLSAFNTSRDGYALLLQTGAIDFAGGGVVHLTGGMAALMGAWIIGPRIGRFDASGKVNEMKGHSATLVVMGTFLLWFGFYGFNPGSNLTIATTASAIVVSRVAVTTTLSAGAAGLTGLFWRYMRTSTWDTVLVCNCCLAGLVGITCSCSVVEPWAALICGFVAAFVFIGFEYVVLYKMKIDDPVSAVALHLFCGVWGLLFPGLLAQPTYVADVYGAYGFGPDVKGSKKFGILYGGHGQVLLCQVIEALSICAWVGVMMGAFFGLLKVAKRLRVPVDQELAGLDVSKHTNEAYNGAIMPTAGGGAGGGGGYGSNGGERGSGFYTGAGPAGDTSTGGGHAANGGYD

SEQ ID NO: 4121 - protein, 612 aa, Spirulina platensis
VQLQTKIAAKRATGAFRLIDSLKRHGVQHIFGYPGGAILPIYDELYRAEAEGDIQHILVRHEQGASHAADGYARATGRVGVCFGTSGPGATNLVTGIATAHMDSIPMVIITGQVARPAIGTDAFQDSDIFGITLPIVKHSYVVREPGDMARIVAEAFHIASTGRPGPVLIDVPKDVGLEEFDYIPVNPGEVSLPGYRPTVKGNVRQINQAIKLIEEAERPLMYVGGGAISATAHAEIAELAELFQIPVTTTLMGKGSFDEKHPLSVGMLGMHGTAYANFAVSECDFLIAVGARFDDRVTGKLDEFGSRAKVIHIDIDPAEVGKNRTPEVPIVGDVRQVLIHLLRRCREIGDVGNDNQTQSWLERINRWPEDYPLVVPSYSDSLSPQEVIAELGKMAPDGYYTTDVGQHQMWAAQFLKNGPRQWISSAGLGTMGYGIPSAMGAKVALERSQVICIAGDASVQMNIQELGTIAQYGINVKTVIINNGWQGMVRQWQQAFYGERYSASNMEIGMPDFEMLARSYGVKGMVVKSRDELHQALAEMLAYDGPVLMDVHVTKDENCYPMVAPGRSNAQMIGLPERRQLEKAVELIYCSNCGAKNVASNNFCPECGTKL

SEQ ID NO: 4122 - protein, 462 aa, Nannochloropsis granulata
MGYWDANYTIKDTDVLALFRITPQPGVDPIEAAAAIAGESSTATWTVVWTDLLTACDVYRAKAYKVDSVPGTSDQYFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNVLLQTTMEINLPQGIFFEQDWASLRKTLPVASGGIHCGQMHQLLNYLGEDCVLQFGGGTIGHPDGIASGATANRVAMESMLLAKYEGKDYVNEGPKILRAAAESCAPLRSALDLWKDIAFNYTSTDTADYIETATKQ

SEQ ID NO: 4123 - protein, 1490 aa, Oryza sativa
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQGTAGVALAGLLGAVRAQGRPLSDFTKQKIVVVGAGSLFHTRYFLSKVCFLRSNSSLESSAGIGVLNMAKQAMLRMPGINRSGEGHNQFWVLDKDGLITKSRKGLDPAVARYARGFGPEEVQDLHEGASLVEVLYTDHQVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAECLASYITDDEIRKGILFPSISSIRHITARVGAAVVRAAVDEDLAEGRCDVDARDLKSMTECWNNSSKKPPAKSAYLRWKKTVGVLPSLLPEVGMEFNTVDEAWMFWVSYGGQKGFEVRKRYSNKRKSDGKVRSCRYVCANEGHRKEDKRDHLTKCPRAETRTDCQVRMGVVLDQEKGNYKVADLVLEHNHILQLPETSHLMVSQRKISELQGFEIETADDAGIGPKAAHQLASIQVGGSLNLNCTLRDHKNYLRGKRQREMVYGQAGSMLMHFQDKIAENPSFQYALQMDSEEQIANIFWVDAKMLTDYAYFGDVVSFDTTFGTNKESRPFGVFVGFNQFRETMVFGAVLLYDETYESFKWLFETFLKAHNGKQPKTIYTDQDSAMGKAIKKVFLESWHGLCTFHIMQNAVKHVAELEDEESSNSPKQTAEDNEEERSILADFSACMFEYEDEETFEQAFSTIRAKASKQSWLDSIYKVKEKWAECYMKDVFTLACTTALEGNNCYLVAIGSLDENCTFEKEYKVVGDPLEQTSTCGCGMFSRTGILCAHALKVLDLMNIKSLPSQYVLKRWTRGAHSGTVQDNHGRSIIENPRLNEMLRYKDMTRKFLNLALRAASHPGSTLLVNNALDILSKQVEEEINGFTDTIALGPTDITPPSDLVSTARLKKKEVETKTSKRKKNWLDKLHKSTKNGSNKGGKRKKKGSKEQKTAKTGGKKKGKEASVHDNPAGQNIYPSTSLPMEEMSEPYMAINTFSQLLTQWSLVLVNRLLVSAGCGTCRDCSFGTLDEQLDLLGKSKVDWLSGVEATGGAELDGRWPEQASGAKRRWPEQGQGATAPRCRGVTGGERGGGWSSGEWRRAPGRWRRDEAERTPTARWSTHLKKRVSPEQKKGGGKSKKKMTWTDVLVPSPSPSSSSTATTNCSRLQRRLGRCAEQHKQGGGGGQDRDPHARPL

SEQ ID NO: 4124 - protein, 274 aa, Arabidopsis thaliana
SSKWDEVKADVRKALENYGCFEASFDKLSVELNRSVFEAMEDLFELPIPTKQRNVSSKPFHGYLCHNLYESLGINDANVLEKVNDFTQQLWPDHGNKSISETIHRFSEKLVELDLMVRRMIMESFGIENYIDEHLNSTYYLTRLMKYTSPPDDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 4125 - protein, 362 aa, Triticum aestivum
MALRRLLQGIVLPRTTGRHVGASFSTEAGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLQFNDQADRIHNAILQTIAEGKYRTADLGGKSSTSDYTKAVCDHI

SEQ ID NO: 4126 - protein, 488 aa, Geobacillus stearothermophilus
MKVQTEIKTYFNYINGNWVSSVSNNVEPSINPANRHDIVGYVQRSTLEDVNEAVTAANEAQTSWWKRSGVERGEYLYKAAHILEQCLQDIAETMTREMGKTLAEAKAETMRGVHILRYYAGEGARKIGDVIPSSDSEGLLFTTRVPLGVVGVISPWNFPVAIPIWKMAPALVYGNTVVLKPASETAVTAAKVIECFHEAGFPKGVVNMVCGSGSVVGQGIANHPDIDGVTFTGSNTVGKQVGRAAFERGAKYQLEMGGKNPVIVAKDADLDLAVEGTISGGLRSTGQKCTATSRVFIEREVYEPFKAKLLERVKQLKIGNGLDAETWMGPCASESQFHTVLSYIEKGKSEGAKLIYGGNRCLEGELANGFFVEPTIFEDVDLQMTIAREEIFGPVLALIQVDSIEEAIKLANDTEYGLSASIYTKNIGNALEFIKDIEAGLIKVNAETAGVEFQAPFGGMKQSSSHSREQGQAAIEFFTSIKTVFVKA

SEQ ID NO: 4127 - protein, 318 aa, Zea mays
  unsure (1)..(318): unsure at all Xaa locations
AGRALSLSLSLSAPHPNRASPPFRPIHPLRGDDTGGRPQARTSPASSPVLVPPPTSGAGLCSSRRLIGLVASVLYTEIIWLSAQWYRPYLTVFLMKWLSSALHVSRLYLILFFSWFAALGEHLFAMGSFSMFGIRLVRQKNCYVCXAFEPENIWQLYDPRRDKWITLPVMPSQIRNIARFGVASVAGKLYVIGGGSDRVDPLTGDHDTIFASNEVWSYDPLHRLWAQRAPMLVARAMFACCALDGKIIVAGGFTNCRKSISEAEIYDPEADTWESLPDLRQAHPSACSGLVIKDKMHVLHKGISTVQILEDGGNYWGC

SEQ ID NO: 4128 - protein, 161 aa, Zea mays
  unsure (1)..(161): unsure at all Xaa locations
ILQRGGATYTTSWGKFWLTVXVLGAYDWSGNNPLPPEMWLLPYHLPFHPGRMWCHCRAVYLPMSYVYGKRFVGXITPLVLELRNELYGGPYNLIDWNKARNQCAKEDLYYPHSFLQDVIWATLHKFVEPVMMHWPGIKFREIALRTAMRHIHYEDESTRYI

SEQ ID NO: 4129 - protein, 473 aa, SYNECHOCOCCUS SP. WH 8102
MAKTPQDVLRQIKDEGIELIDLKFTDLHGKWQHLTVCTDLLEEDSFTEGLAFDGSSIRGWKSINASDMAMVPDASTAWIDPFYRHKTLSMICSIQEPRSGEAYDRCPRALAQRALNHLSSTGLADTAFFGPEPEFFLFDDVRYNSSEGGAFYSVDTIEASWNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMVMAGLDGIKNQIDPGDGEDRDLFELPAEELAKIATVPPSLNGALEALNADRGFLTTGGVFSDDFIDNWIDLKYEEVQQLRQRPHPHEFAMYYDA

SEQ ID NO: 4130 - protein, 145 aa, Listeria monocytogenes EGD-e
MDESKKNERLQQLTDIQYNVTQKAGTERPFQNEFYDNEVKGIYVDIVSGKPLFSSNDQYDAGCGWPSFTKPIDEAEVIEHRDLTHGMIRTEVKSADADSHLGHVFPDGPQDKGGLRYCINSAALRFIPVDKLEEEGYQAYKKIFE

SEQ ID NO: 4131 - protein, 98 aa, Buchnera aphidicola
LPSASLNDSNFGLYEPAGGSAPDIAGKNIANPIAQILSIAMLVRYTMKLPIISDQIESSVIDTLKKGYRTLDIANDKEKCESTNDIGDIISYILKKRI

SEQ ID NO: 4132 - protein, 503 aa, Xanthomonas campestris pv. campestris str. ATCC 33913
MDPQPAGGSTMHALPSIATPTTATPAWHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 4133 - protein, 328 aa, Glycine max
  unsure (1)..(328): unsure at all Xaa locations
LSLEEVNHSADAHRTDXMTITQFVLNXQFEHPESSGDVNILLSHIVLGCKFVCSAVNKDXLAKLIGLAGDTNVQGEXENKLDVLSNEVLIKALISSXRTCILDSXEDGSSTIDCGVSIGKIFGVYALKDVHEPTIEDVLLPVKNMVAAGYSGHTTYGSSCTPVLNTGAGVNGFSLDPSLGEFILGTPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 4134 - protein, 476 aa, Gymnogongrus sp. FredericqS_19.i.95_2
NERYESGVIPYAKMGYWDPDYVIKDTDVLALFRVTPQPGVDPVEASAAVAGESSTATWTVVWTDLLTACDLYRAKAYKVDNVPNTSDQYFAYIAYDIDLFEEGSIANLTASIIGNVFGFKAVKALRLEDMRLPVAYLKTFQGPATGIICERERMDRFGRPFLGATVKPKLGLSGKNYGRVVYEGLKGGLDFLKDDENINSQPFMRWKERYLYSMEGVNRSIAASGEIKGHYLNVTAATMEDMYERAEFAKELGSIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVVARNEGRDYVAEGPQILQDAAKTCGPLQTALDLWKDITFNYTSTDTADFVETPTANV

SEQ ID NO: 4135 - protein, 453 aa, Oryza sativa (japonica cultivar-group)
MGAIGEWRRGPVIGRGATATVSIATDRRTGGVFAVKSVDVARAGALRREQGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGELAAAADGPRGHDDDDDDDDHGVSSSPCSWRRSNSAISGCETERGAVAVAATVPLMAKSSEITGVERSIESRVASGSG

SEQ ID NO: 4136 - protein, 231 aa, Streptococcus pneumoniae TIGR4
MSRIEFSPSLMTMDLDKFKEQITFLNDKVASYHIDIMDGHFVPNITLSPWFIQEVQKISDTPLSVHLMVTDPTFWVDQVLDLQCEYICIHAEVLNGLAFRLIDKIHDAGLKAGVVLNPETPVSTIFPYIDLLDKATIMTVDPGFAGQRFLESTLYKIQELRQLRVQNGYHYIIEMDGSSSRKTFKQIDVAGPDIYVIGRSGLFGLDDDIAKAWDICSRDYEEMTGKTMPIK

SEQ ID NO: 4137 - protein, 484 aa, Rhizobium sp.
MKKLTNATGAPVADNFNIQTAGPRGPALLQDIWLLEKLAHFDRELIPERRMHAKGAGAYGTFTVTHDITRYTKASIFSSVGKETPLFVRFSSVAGERGSADAERDIRGFAVKFYTDEGNWDIVGNNTPVFFFRDPLRFSDLNHVVKRDPSPALRNATSNWDFWTLLPEALHQVTSVMSDRGLPTSFRHMHGFGSHTFSLIDRDNKRVWVKFHFVCQQGIENLSDAEAEAVVGKDRESNLRDLYEVIEQGNFPRWKLCIQVMEEEQALNYRHNPFDLTKVWPHAARVIEVGIMELNRNSRKANFAEIEQAAFSPANVVPGVSFSPDRISRARLFSYGDAQRYRLWLNFNHIPVNAPRCPASSYHRSYHRDGAMHADGNLGGTASYFPNSVGEWQDSPERAEPPLPLEGFDQHYDHRLEEDHYEQPGNLFRLLDPARNELLFDNTARAMNGVPQRIRQRHMTIAPKPSPAYGFGVAEALERLVPLG

SEQ ID NO: 4138 - protein, 538 aa, Agrobacterium tumefaciens str. C58
MCRENAGGHTHRRLHCPPAAKQDFRSPPPPQSVDAACHQGLGLRHVHRGFPMTLSFDPDSLTLPIGHFIGGRLIPAQNGIDMHRPSDGVEYAGCPRANAALVDEAVQTAKAALKSSNWGGVRPRERTKILQRWADLIEQEAETLAKIEALSSTRPVGQLIAGDIAVTAEQIRFFAEFADKEGGDLVPTDDASLGMIMTEPYGVVGAITPWNFPVSMAGWKLGPALAAGNAVVLKPSEMTPFSSIFMAELAIKAGLPAGLINVVLGDGPVTGNAITGHPEISKVSFTGSTAAGAAIMANVARTGIKPMTLELGGKSPQLVFADADIEKAAAAIAGNILSNAGQACVAGSRIIVEESAADALSAAIIARMKTVKPGPTWDEATQYSPIISEVQRQRIDGIVQAAVAHGGECLTGGAIMDGPGYFYQPTLIANVDQTSPAVTEEIFGPVLTLQTFRTEEEALALADHPTYGLAAGLFSRDVSRVLRLSRAIQAGTIWVNRYGRSRDHILPTGGYKRSGIGKDLGRDAYLANRKSKSVLIGL

SEQ ID NO: 4139 - protein, 178 aa, Triticum aestivum
MARPRAWAPFPGSALSLLSVLLLLVGRRGAAGGGGGRGSSVYPAPVVYPHHSRQISWHPRAFLYPHFLTDDEANHLVSLARAELKRSAVADETSGKSKLSEVRTSSGTFSKGQDPIVAGIEDKIAAWTFLPKENGEDMQVLRYKRGEKYEPHHDFFTDSVNTIRGGHRVATVLLYLTD

SEQ ID NO: 4140 - protein, 172 aa, Triticum aestivum
  unsure (1)..(172): unsure at all Xaa locations
MAPTVMASSATSVAPFQGLKSTAGLPVSRRSNGASLGSVSNGGRIRCMQVWPIEGIKKFETLSYLPPLXSTEALLKQVXDYLIRSKWVPCLXEFKQVGFIFRXEHNAPPGYYDGRYWDMWKLPISGAPXPTQVINEVEESRRIPDAYSASSVRHIASACVAHASTTGSRSEG

SEQ ID NO: 4141 - protein, 361 aa, Lolium perenne
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFAGSMVVDQKFVVKIPAGLAPEQAAPLLCAGVTVYSPLKHFGLMTPGLRGGILGLGGVGHMGVKVAKSMGHHVTVISSSDKKRAEAMDDLGADDYLVSSDEAQMAAAMDSLDYIIDTVPVKHPLEPYLALLKMDGKLVLMGVIGEPLSFVSPMVMLGRKTITGSFIGSIEETEEVLRFCVDKGLTSQIEVVKMDYLNQALERLERNDVRYRFVVDVAGSNIDDTAA

SEQ ID NO: 4142 - protein, 470 aa, Shigella flexneri 2a str. 301
MVDQVKVVADDQAPAEQSLRRNLTNRHVQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 4143 - protein, 520 aa, GIBBERELLA ZEAE PH-1
MSTFQKKLLAAIIKSLLRGKSLVQSLLAYWSSSLGHDTSSKPRVGNTPRRSIQEFLKEAETLFLDPIGQDSLQQLSRNLRKQLLQRLEADMECMLPSYSHQLPRGTEVGRFVALDVGGSTLRVALVELCGRMSNIGEESKIASMRNFRITPDIKALEGMAFFDWMAEKILETLSEELEQDGRSDGPLPMSMAWSFPIEQTSLAGGKLQGMGKGFCACDGLLGWDLGDIVRTACLNRGLNVELRAIVNDSSACLLSESYNHPTTRFGLILGTGVNLAAYLPVSAIGRVKFGQRPPQWFEKATHVIINSEISMMGRDILPLTRWDRQLLANHARPEFQPLEHMVSGIEFDHSVDYDGTLMMNRDTTSGLEEARKQFSSCHPAKHAPTTADMELLKQLAGFISKRSSALVATGVHAFWNLRIESQNNFVQTMSTESPERESAEADRDLAETTVAYNGGVIESYPGYLDSCQSYLDELVAGDKREKSGNRTIKLVSAKESSLMGAAVALASLEEVVEGPLGVVG

SEQ ID NO: 4144 - protein, 68 aa, Oryza sativa
  unsure (1)..(68): unsure at all Xaa locations
GPRKAQNEDKFHSFHPVATILSYLTKAPLVPPGTPXVNPLSKQRAMLENIMRACVGLAPENNMILEYK

SEQ ID NO: 4145 - protein, 619 aa, GIBBERELLA ZEAE PH-1
MALMSMIPSPRRCVVLLSLSLTPTLVAAVNPATSTKAAAADYYVRDLPGLPADGPKVNMHAGHIEVTPESHGNLFFWHFENQHIADKQRTVIWINGGPGCSSEDGSMMEIGPYRLTDQDNLVYNNGSWNEFANLLFVDNPVGTGFSSVDTNSYIHELKEMADQFVIFLEKWFALFPQYDRDDIYIAGESYAGQHIPYIARAILDRNKKDSKTAWNLKGLLIGNGWISPAEQYPAYITFGIEKGIIEKDSDNHKKLQADLRSCEKMMASDVGHVDYGECEAILSNMLKLTKKGDGDDACINMYDVRLKDSYPSCGMNWPPDLVHLTPYLRKPEVTSALHVDAIKKSVGWTECNGAVGGAFNAKNSKPSVELLPNLLKEVPIMLFSGAEDLICNHVGTENMINKMEWNGGKGFEVTPGNWAPRRDWDFEGETAGFWQEARNLTYVLVYNSSHMVPFDLPRRSRDMLDRFMGVDISSVGGDPADSRIDGEKGPKTTVGSAKNSTQNAAEDEHQKQLDEAKWAAYYKSGEIVLVIVVIGAVAWGYWIWRERRKGAAYSVLADHDLSRRSTGHRAKSQPGDLETAAFDESELDDLHVTTPGTSTSARFPKNQDGSEKFVTKYAE

SEQ ID NO: 4146 - protein, 532 aa, GIBBERELLA ZEAE PH-1
MSRAGSPGLPVKVVPETSYPESRVLIIGTGGTICMQQGPDGLQPTDNFLENAMAPRSSFNDFSNPGTLPAVRDGAKIQIGSLRTPATAYNRHVRYGIIEFSPLLDSSSISAHDWDAMASCVEENYHLFDGFVILHGTDSLAYTASALSFMMENLGKPVILTGSQAPIFALQSDGVDNLLGSLIIAGTFTIPEVCLFFHHRLYRGNRSAKVSATEFEAFASPNSEPIAKVNGLGISVNWPLVLRPTSIAKFHVTKGLDTTHVACLRVFPGIKPEMIDAVLHLPDIRGLILETFGMGNIPGGSDGPLTRIIKDAVERGIVVVNVSQCVNGFVSPVYAPGTVLGRAGVIFGLDLTAEAALAKVSYLLAQPDLSTKEIQEKLSRSLRGEMTEIAHQSFSNPAGSLDFAAAHLTASERAFSALGYAIENGELKLVKELLQGEGAQLLKQADYAGNTAVHLAAVAGKTDILLELLRLGASVHERNKANLSPLYVAVKSGQEPCAQLLRIAGAHLAVEERETMPGYVTPKYSHFGKHEL

SEQ ID NO: 4147 - protein, 446 aa, Zea mays
  unsure (1)..(446): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDXLKDLYKSFVSEYPIESIEDPFDQDDWSTYAKLTDEIGRKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4148 - protein, 391 aa, Glycine max
MSLTLQTPPSTTLSSASPIHRTITRYTTFSFSLRPPTTLHFNPHRSLPLIRASNSSINAASTTELDAVSAFSEIVPDTVVFRCISKIFLPILLGICGLPDTIFRNAVEMALADSECYGLENPNARLSCFVNKAFANIGSDMAKLVPGRVSTEVDARLAYDTHAIIRKVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESVASPDEKYSFVRRLSPQSAAKYTFSDEELVRWDEDSLSKAMGPAAVQLLAAGLDGHADQAKRVEELFGKIWPPPNV

SEQ ID NO: 4149 - protein, 480 aa, Martensia elegans
QAIKNERYESGVIPYAKMGYWDPDYVIKETDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKQLGTVIIMIDLVIGYTAIQTMAIWSRKNDMILHLHRAGNSTYSRQKVHGMNFRVICKWMRMAGVDHIHAGTVVGKLEGDPLMIRGFYNTLLDPYLDINLPQGIFFQQDWASLRKVTPVASGGIHCGQMHQLLDYLGNDVVLQFGGGTIGHPDGIQAGATANRVALEAMVIARNEGRDYVTEGPQILRDAAKTCGPLQTALDLWKDITFNYTSTDTADFVETPTANV

SEQ ID NO: 4150 - protein, 371 aa, Oryza sativa
  unsure (1)..(371): unsure at all Xaa locations
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTSTTKSGPSLHSRFXYVENEPAVDSRNGGTQMTGHVAPPKSSNFFQEYGMDNGFQKKTSTAATKTQGSSSISSADLFGRRDMDDSNLDLSAADLINRISFQASQDLSSLKNMAGETGKKLTSIASNFISDLDRIL

SEQ ID NO: 4151 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 4152 - protein, 314 aa, Glycine max
MAVKSSKPNRGRFMLSCFAFIVFLCVFASINEVRFNSLLRFGRCALSNESLPTNSEDNDLRILISVLTLPDQYQRRHFLRLVYGTQTIIEGAKVDVKFVFCNLTKQDQKVLVALEIMQYNDIMILNCTENMNKGKTSTFFSSLPEIFNKETTTSGIVPYPPYHYVMKADDDTYVRVNSLVRSLRPLPREDLYYGFVIPCGSMDPFKHYMSGMGFVVSWDIVEWIHGSDIPKKHVEGPEDKVFGDWMRWARRGNNRFNAKWSMYNYPDPPSVCSHELWNDTIAVHLLKNQEKWIRTLTYFNHTDSLKPSKLYHIS

SEQ ID NO: 4153 - protein, 115 aa, Triticum aestivum
  unsure (1)..(115): unsure at all Xaa locations
PGRTHVREGVXYYPSRHAPLRHAXPASFPVPTRPVVGXREKTRIKKEKRLXXQPXERYRSWAPDRQDRFVRRFADALARPKVSHELRVIWIDFLSKCDKSCGMKVANRLNVKPSM

SEQ ID NO: 4154 - protein, 380 aa, Novosphingobium aromaticivorans
MQRNRPRARWNLWHRRGGRLPLRHLTGIMAPSSERRSVVLRWRRRTMIPHGEHSMLAMQLDGPGKRLHPVVRPLPLPGRGEVRVKVHACGVCRTDLHVADGDIHGLLPIVPGHEVIGVVDALGPGVTDVEPGARVGVPWLGHACGTCPYCDSGRENLCDAPLFTGFTRDGGYATHVIADARFCFPIPEGFDDLHAAPLLCAGLIGYRALRLAGDAPVLGFYGFGAAAHILAQVALWQGRTVYAFTRDGDAKAQAFARDIGCQWAGPSGAAPPQALDAAIIFASAGELVPTALRAVRKGGRVVCAGIHMSDIPAFPYADLWEERQILSVANLTRRDGVEFLPLAARAGVRTHVEAMPLMKANEALDRLRRGDVSGALVLVP

SEQ ID NO: 4155 - protein, 400 aa, Triticum aestivum
  unsure (1)..(400): unsure at all Xaa locations
NSARVRRNATSDDFMSAVSFRTYAVSTSGGSRKAPTEAKLKVAFGACGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEAGAKKVLITAPGKGDIPTYVCGVNADLYTHADTIISNASCTTNCLAPFVKVLDQKFGIIKGTMTTTHSYTGDQRLLDASHRDLRRARAAALNIVPTSTGXPAKAVALVLPNLKGKLNGIALRVPTPNVSVVDLVVQVSKKTLAEEVNQAFRDAAANELKGILDVCDEPLVSVDFRCXDVXFXIDAXLXMGHGRTWVVRVGTNNQVGVTSQKGVRTFANLQPNKLKRPDGGGNLALCEKTSKKFFPQPP

SEQ ID NO: 4156 - protein, 222 aa, Triticum aestivum
  unsure (1)..(222): unsure at all Xaa locations
LFSLSLVDENKVTIGASGAIPALVLLLGNGSQRGKKDAATALFNLCIYQGNKGKAVRAGLVPILLELLTETESGMVDEALAILAILSSHPEGKAAISAAAAIPILVGVIRNGSSRNKENAAAVLVHLCNGEQQQQHLAEAQEQGIVTLLEELAESGTDXRGKRKAIQLLERMNRFLKQQSQAQGDANGTGACSVPNPVPGSGSSSSRYSARGITASYIISSS

SEQ ID NO: 4157 - protein, 326 aa, Rickettsia rickettsii
MDIKLGKYKPTKEEYIKSFKDMLLLRRFEEKCGQLYGMGEIGGFCHLYIGQEAVISAVDMVKQKGDSTITSYRDHAHIILAGTEPKYVLAELMGRATGCSKGKGGSMHLFNVPHKFYGGHGIVGAQVPIGTGLAFAEKYNDTHNICFTFLGDGAVNQGQVYEAFNMAALWGLPVVYIIENNEYSMGTSVARSTFMRDLYKKGASFGIKGFQLDGMDFKEMYDGSKQAAEYVRENSFPLILEVKTYRYRGHSMSDPAKYRSKEEVEQYKERDPLVIIRKTILDNKYVTEADLKAIEQSVKEIVKEAVEFSENSPLPDEGELYTQVYC

SEQ ID NO: 4158 - protein, 752 aa, GIBBERELLA ZEAE PH-1
MVANSTGRDASALKSRKRAADSESEPLLKQGQPFPKQPRIGSELDKTRWRLKDDDSRHTWHYLEDDDAAKEWPQSYAEKWYLNQSLDLPDLPSPDSPLAAATNGLDFFEKLQLPSGHWGCEYGGPMTPISPSKATAIYNYISARAHPEDGGWGLHIEGESSVFGTLMNYVALRLVGVEADDPVLVKARGTLHKMGGALYAPHWAKFWMGVLGVMDWDVVNPVPPEIWLLPDWVPFAPWRWWIHIRMVFLPMGWLYSKRWSCEETDVIRSLRKEVFIEDYAKIKWTSHRNDIGVVDNYHPKSWLLNTANWLIVNIWNPYLRPNVLKEKAEAWSSKQVDMEDANTDYACLAPVNATMNTVMCYARDGPDNYGVQRHIERLEEFLWVKDEGMLVNGTNGVQCWDTAFLIQAVFEAGLHKDEKWKPMLMKSLQYLERQQIREDCVDQDVCYRQPRKGGWPFSNKDQGYGVSDCISEAMKAIILLQKVGGLPEVLEERRLFDAVDTLLLYQNSNGGMSSYEKRRGGEWLEMLNAAEVFGRIMIEYDYPECTTACVTALSLFNKYWPDYRTKEVKTLIRTAAEWIKSNQRPDGGWYGSWGICFTYAGMFALESMKHIGQTYATGENSRRGCDFLISKQRADGGWSESYKACETMEYVEHPSGSLVVQTAWALIGLMEADYPHVEPLKRGIQLIMDRQQPNGEWLQEAIEGVFNKSCMISYPNYKFTFTIKALGMFAKRFPEEKLVPSWALQGNGIEKS

SEQ ID NO: 4159 - protein, 468 aa, Brucella suis 1330
MKQYTLLIGGEHVATPNHAEVRNPSTGEVVGLMPLASEADLDRAVAAAANAFQTWSRTGDAERAAACRAIANKLSEDAEELARLLTLEQGKTFNGLGSRFELGGAMAWTRHTAELGLPVEVVQDDNEGRVEIHRKPIGVTGSITPWNWPVMIACWHIIPAVRTGNTVVIKPSPLTPLSTIRLVEIINEVLPAGVVNVVTGENSIGAALSAHPGIAKMTFTGSTETGRKIMASAAATLKRLTLELGGNDAGIVLPDADPARIAEGLFWGAFINSGQTCAALKRLYVHDHIYDDVCRHLTEYAANIIIGDGLDEKSVLGPVQNAMQFNKVRELVDDARAKGARIPIGGEAAEGPGYFYPITLVADIDNGTRLVDEEQFGPVLPIIRYSDIDEVIRRANDNPSGLGGSVWSSDVEKARAVALQLECGSVWINKHGAIQPNAPFGGVKQSGIGVEFGTDGLKEFTTIQTVLS

SEQ ID NO: 4160 - protein, 474 aa, Solanum tuberosum
DLFLLSFATILTIIIYVFFKYFFAKPKEKIPPGTFGWPIIGETIQFFISLYYGMVHEFVQERTKKYNSHVFKTSLLGQKVVIFSGPAANKFIFTQGNKLIIGWRPKSVQKLFASTSFVPIEHDTKRAHNVISYLLNSQNVERLISTMDNMSHLHLKNHWKGKNEVIVYDLVKLFTFSLSIRAFIGIKESDKILNLYEKFKIFTYGLLAVDINLPGTTFYKAMKAGNELRKQMKVIIKQRRAELSENPNLSKVDVLTQMINEQDEDGKYMTEVEIEDKVFGFIIGSYDTTATTITLTMKYLQQMPEFFNEIIQEQNEISMQMMPRKELCWNDIQKMKKTWSFVNEVLRNTPVVQGIFREVIEDFTYEDFYIPKGWKIYLSFGATQKNGEYFPNPTKFDPSRFEGNGQVPYTSVPFGGGHRMCPGKEFARILILVFLHHLLKNFRWEPKVPSEKILYPFFLLAIPTDGYPITLSAV

SEQ ID NO: 4161 - protein, 373 aa, Glycine max
MAFHDHLPHEITFQPFTEEQQQQQLGQSRDMQRLLPLSGGAPTWLNNSTAATLRQQNFLHLQPESAATTQQNDDVRGGGGSGMDRNRTESNSEPDDLAEYKADILGHPLYDQLLSAHVSCLRIATPVDQLPRIDAQLQQSQRVVDKYSGIGNGNGVVDDKELDQFMTHYVILLCAFKEQLQQHVRVHAMEAVMACWELEQSLQSLTGVSPGEGTGATMSDDEYYQAESNANLFEGSMDGADSLSFGPLVPTETERSLMERVRQELKHELKQGYKDKIVDIREEILRKRRAGKLPGDTTSLLKAWWQSHSKWPYPTEEDKARLVQETGLQLKQINNWFINQRKRNWHTNPSSSSGSKSKRKSSGAGETSNQSFM

SEQ ID NO: 4162 - protein, 486 aa, Azotobacter vinelandii
MKEIKHFINGEYVGSASGKLFDNVNPANGEVIARIHEAGEAEVDAAVKAARAALKGPWGKMSVAERTEILHRVAAGITARFDEFLEAECQDTGKPKSLASHIDIPRGAANFSVFADLVKNVPTEAFEMATPDGSGALNYGVRRPKGVIGVISPWNLPLLLMTWKVGPALACGNTVVVKPSEETPSTTALLGEVMNAAGVPAGVYNVVHGFGGNSAGAFLTAHPDVDGITFTGETGTGETIMRAAAKGVRQVSLELGGKNAGIVFADADLDKAIEGTLRSAFANCGQVCLGTERVYVQRPIFDAFVARLKAGAEALVIGEPNDPKANFGPLVSHKHREKVLSYYQKAKDEGATIVTGGGVPDMPQHLAGGAWVQPTIWTGLKDDSPVVTEEIFGPCCHIRPFDTEEEAIELANSLPYGLASAIWTENASRAHRVAGRIEAGIVWVNSWFLRDLRTAFGGAKQSGIGREGGVHSLEFYTELKNICVKL

SEQ ID NO: 4163 - protein, 243 aa, Bacillus licheniformis
MSYRVKRVLLLLVTGLFLSLSAVTSTASAQAGGSFFDPFNSYNSGVWQKANGYSNGGVFNCTWRANNVSMTSLGEMRLGLTSPSYNKFDCGENRSVQTYGYGLYEVGMKPAKNVGIVSSFFTYTGPTDGTPWDEIDIEFLGKDTTKVQFNYYTNGVGNHEKLVNLGFDASNSYHTYAFDWQPNSIKWYVDGQLKHTATSQIPTTPGKIMMNLWNGIGVDDWLGSYNGVTPLYAHYDWVRYTKR

SEQ ID NO: 4164 - protein, 483 aa, Glycine max
MDWRRWTKNKKNHHHPSPKLQPRLERLNAKKGINYQSPPSPPSPSSSSSHLDRQTSFRLFGFDGEFDRIFQTLGLSGPEDFSIPTADWEAHKARLFGPTTTPPPHTLPPTSQIQDDDVSVPAAVSSSSPWSSGEHYVGRGSVGRLNLRHGERSVLFTDSDSFTTSHDADAPVRLERERACLAPNSAPADELVIPFNSSGEWFRQTFTSWQKGDVLGNGSFGTVYEGFTDDGFFFAVKEVSLLDEGSQGKQSFFQLQQEISLLSKFEHKNIVRYYGSDKDKSKLYIFLELMSKGSLASLYQKYRLNDSQVSAYTRQILSGLKYLHDHNVVHRDIKCANILVDVSGQVKLADFGLAKATKFNDVKSSKGSPYWMAPEVVNLKNQGGYGLAADIWSLGCTVLEMLTRQPPVFSVQQMQALFRIGRGEPPPIPEYLSKEARDFILECLQVNPNDRPTAAQLFGHPFLRRTFLSPLSFASPHRNIYRL

SEQ ID NO: 4165 - protein, 123 aa, Glycine max
  unsure (1)..(123): unsure at all Xaa locations
MAHPTSSGQSRDLKKEDRQETRSLVDCFVERLIDFAPTGGGVXLAEAPAFKKAPGGAPADEADGISGLGGPSCFIGQVGADEYGNMLGNILKQNNAETSGMRLDSNAGTALAFXTLRTDGDVS

SEQ ID NO: 4166 - protein, 461 aa, Mesorhizobium sp. ZJ15B7
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 4167 - protein, 340 aa, Streptomyces galbus
MPIATPEVYNEMLDRAKAGKFAYPAINVTSSQTLNAALRGFAEAESDGIVQISTGGAEFLGGQYSKDMVTGAVALAEFAHIIAEKYPVNIALHTDHCPKDKLDGYVRPLLALSKKRVEAGLGPLFQSHMWDGSAEPLADNLAIAQELLETARAAQIILEVEITPTGGEEDGVSHEINDSLYTTVDDAIRTAEALGLGEKGRYLLAASFGNVHGVYKPGNVVLRPELLKELNEGVAARFGKESPFDFVFHGGSGSSEEEIRTALENGVVKMNLDTDTQYAFTRPVAGHMFANYDGVLKVDGEVGNKKAYDPRTWGKLAEASMAARVVEATQHLRSAGNKIK

SEQ ID NO: 4168 - protein, 339 aa, Pyrococcus furiosus DSM 3638
MSIIQDIIGRIVVLRGGQYSVEVDVVTDESFGRFAAPIDENPALYIAEARRAVSEVDEIIGPELIGFDAIDQELIDSYLWEIDGTDNFSHIGANTALAVSVAVAKAAANSRNISLYSYIGGTFTTELPVPVVTFGADENFEYHVIVRDLLEVTDIIDAVVRLLDFSLSLEELSKASEQVGLELGLEVSLGITMRKELETEKVLEIVEDYNIAYIKPIGTPELFLELIAGTHGVFIDGEYLYRKYNILDRKYYNALSIKPINLGTLTDLYNFVNDVKAEKITPILSESKYEPADETLPHLALGLRCPAMLIHMNSVEKINELNRIAEELGERGRIITFEE

SEQ ID NO: 4169 - protein, 569 aa, Eremothecium gossypii
MSDAVERHTFKVFTQDFMVDKRFQLIKEIGYGAYGIVCSARFMESVEDTTVAIKKVTNVFSKALLCKRSLRELKLLRHFRGHKNITCLYDMDIVLLPDGSFNGLDLYEELMEWDMHQIIKSGQPLTDAHYQSFVYQILCGLKYIHSADVLHRDLKPGNLLVNADCQLKICDFGLARGYSENPIENDQFLTEYVATRWYRAPEIMLSYQGYTRAIDVWSCGCVLAELLGGRPIFKGKDYVDQLNRILQVLGTPPEETLKRIGSKNVQDYIHQLGYIPKVPFERLYPNANPDAADLLERMLALDPKTRITVDEALEHPYLSIWHDPSDEPVCCKKFDFSFESVNEMEELKRMVIEEVKDFRRFVRQPNIRDTSLQEQEEQQPQQPQQPQQPQPEQPQHQRQHQQAQAQAQAQAHEQQQQHHRTQYQRSGAVQRQPQTVEHGQHLQHRSGHHSEHLQRAHGQQEQYLPKKDDSRAFQSRPVGTSISDSRSSYEEHDYVQQMMFAHSPTLAHDSFIGIHSENLPEHNTDFPPRPQENMLASPMGFSDGTHSNAEFGDFLDLEKELEFGLDRKI

SEQ ID NO: 4170 - protein, 318 aa, Striga hermonthica
MATFPVINMAKLNGEGRPATMAQIEDACQNWGFFEVVNHGISAEFMDRVERLTKEHYKKCMEQRFKEMVAAKGLEAVQSEINDLDWESTFFLRHLPSSNISEIPDLHPEYREVMKEFAAHLEKLAEHLLDLLCENLGLEMGYLKKVFYGSKGPTFGTKVSNYPPCPKPDLIKGLRAHTDAGGIILLFQDDKVSGLQLLKDGQWVDVPPMRHSIVVNIGDQLEVITNGKYKSVMHRVIAQTDGTGRMSLASFYNPGSDAVIYPAPALVEKAENNELYPKFVFEDYMKLYAGLKFQAKEPRFEAFKNMDKAANLGPIATA

SEQ ID NO: 4171 - protein, 669 aa, Amaranthus powellii
MASTSSNPPFSSFTKPNKIPNLQSSIYAIPFSNSLKPTSSSSILRRPLQISSSSSQSPKPKPPSATITQSPSSLTDDKPSSFVSRFSPEEPRKGCDVLVEALEREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLSLHMLGMHGTVYANYAVDKADLLLAFGVRFDDRVTGKLEAFASRAKIVHIDIDSAEIGKNKQPHVSICGDVKVALQGLNKILESRKGKVKLDFSNWREELNEQKKKFPLSFKTFGDAIPPQYAIQVLDELTKGDAVVSTGVGQHQMWAAQFYKYRNPRQWLTSGGLGAMGFGLPAAIGAAVARPDAVVVDIDGDGSFIMNVQELATIRVENLPVKIMLLNNQHLGMVVQWEDRFYKANRAHTYLGNPSNSSEIFPDMLKFAEACDIPAARVTKVSDLRTAIQTMLDTPGPYLLDVIVPHQEHVLPMIPSGAAFKDTITEGDGRRAY

SEQ ID NO: 4172 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 4173 - protein, 252 aa, Zea mays
  unsure (1)..(252): unsure at all Xaa locations
AEIGLLATVGVTTVKVYPRPTIAVFSTGDELVQPATATLSRGQXIRDSNRAMLLACAIQQKCKVVDLGIAEDTEESLKEHMDAALRSNADIIITSGGVSMGDRDLVKPCLAKMGKIHFEKIQMKPGKPLTFAEITTQDTPKPSKTVLAFGLPGNPVSCIVCFNLFVVPAIRLLSGWSNPHLQRVHVRISHPLRADPHRTEFHRAAIRWVLDDGSGRPGFVAESTGHQASSRLLSMKSANALLEIPSTGQILA

SEQ ID NO: 4174 - protein, 493 aa, Frateuria sp. ANA-18
MSKKFIEQHGLWTDVQKAAAVEVLKQADQAGLQMIRLSWPDQYGLLRGKMLSIAALRSAFGSGSEITMAPFFFDTASAIVFNPFSADGGFGSAELAGSPNVVMVPDPTTFHILPWADRTGWMLADLYMTSGRPFPLSPRAILKKGLRELEALGYDFQAGLEVEWYLTRIVDPCLDPETIGSPGTPAAPPKVMPVAKGYSYLLENHLDEVEPIMAEVRHHLLALGLPLRSIEDEWAPSQMETTFDVMPGLDVADSMVLFRNAVKQICRRRGYLASFMCKPAINGFYASGWHLHQSLTARDTGFNAFIPQQGEPLSQLGQAYVGGLLEHACAASSFTTPTINGYRRRRPYSLAPDRVTWAKDNRAAMARVISAPGDPASRVENRIGEPAANPYLYLASQVFSGIDGIRRQRDPGPLQETPYASRCDDFDRTTCPRALEALESSSFFREAFGDEFIHYWLHLRRSEWKRFTEAEGEVDMAADPVTHWEHREYFELF

SEQ ID NO: 4175 - protein, 352 aa, Haloferax mediterranei
MSTDSDAETVDLADGVDHQVAMVMDLNKCIGCQTCTVACKSLWTEGGGRDYMYWNNVETKPGKGYPRNWEESGGGWKSSEHKERKPGQIPDKEDYGDAWEFNHEEIMYNGSDRPLRPDSDPEWGPNWDEDQCTGEYPNSYYFYLPRICNHCTHPSCVGSLPRKAIYKREEDGIVLIDQERCRGYRYCVEGCPYKKVYYNATQKTSEKCIFCYPRIEGEGPDGKTFAPACAEDCPPQLRLVGFLDDEQGPIHKLVEEYEVALPLHPEYQTQPNVYYIPPFAPPQHSEDGESVDVDRIPRNYLEELFGERVHDALRHIEREREKSHRGGGSELLDMLTDTNPARKFRLEVFDDD

SEQ ID NO: 4176 - protein, 242 aa, Oryza sativa
QGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLKKQPC

SEQ ID NO: 4177 - protein, 289 aa, Raoultella terrigena
MKGIVLAGGSGTRLYPITQGVSKQLLPIYDKPMIYYPVSVLMLAGIRDILIISTPEDMPAFQRLLGDGSQFGVNFSYAIQPSPDGLAQAFIIGEEFIGNDSCALVLGDNIYFGQSFGKKLEAAASKTSGATVFGYQVLDPERFGVVEFDENFRALSIEEKPLKPKSNWAVTGLYFYDNDVVEMAKEVKPSARGELEITTLNQMYLERGDLQVELLGRGFAWLDTGTHDSLMEASQFIHTIEKRQGMKVACLEEVAFRNKWLSAEGVEAQAERLKKTEYGAYLKRLLNER

SEQ ID NO: 4178 - protein, 136 aa, Zea mays
PNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 4179 - protein, 261 aa, Passiflora edulis
VLNHGIPNEFMDTVERMTKAHYNKCMEQRFNELVASKALEGVQVELKDMDWESTFYIRHLPESNIAEIPDLDDEYRKVMKDFAAKLEKLAEELLDLFCENLGLEKGYLKKALYGSRGPTFGSKVSNYPPCPKPELVKGLRPHTDAGGIVLLFQDGKVGGLQLLKDGQWVDVPPIPHAIVINIGDQLEVITNGKYKSVDHRVVAQTDGARMSLASFFNPGSDAVIYPAPALVEKEAEEKKQLYPKFVFEDYMKIYAGLKFHA

SEQ ID NO: 4180 - protein, 510 aa, Glycine max
MFIENFKVECPNVKYTETEIQSVYNYETTELVHENRNGTYQWIVKPKSVKYEFKTNIHVPKLGVMLVGWGGNNGSTLTGGVIANREGISWATKDKIQQANYFGSLTQASAIRVGSFQGEEIYAPFKSLLPMVNPDDIVFGGWDISNMNLADAMARAKVFDIDLQKQLRPYMESMLPLPGIYDPDFIAANQEERANNVIKGTKQEQVQQIIKDIKAFKEATKVDKVVVLWTANTERYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKSTIVLHNTCEDSLLAAPIILDLVLLAELSTRIEFKAENEGKFHSFHPVATILSYLTKAPLVPPGTPVVNALSKQRAMLENIMRACVGLAPENNMILEYK

SEQ ID NO: 4181 - protein, 312 aa, Triticum aestivum
  unsure (1)..(312): unsure at all Xaa locations
MEIARVDLRGLEPGGPGWAEARDAVTASVVAHGFVVVAHDALGLELRQALFGRVMPEIFALPPEAKQRNVSEVGPFRGYISNVPGTNWESVRLSEPTDAGRVRDFADLLWPQGNPAFCDTIASAAKNVWELQRTVETMILEGLGVGEERIGAHLDTLAHSVRXSRYGPPRPDAETSMSLQAHRDXSIMTAIVQHGVEGLEVQVQDGIWLAVPPEPDLFTFVAGELFTVVTNGRVPGCFHRVRTPSNRERLSALFGCPGKDGVLLSAIDELVDDEHPLLYRPCTNDGYTTFRHSEEGRKSGDPLKAFCGVQKD

SEQ ID NO: 4182 - protein, 333 aa, Synechocystis sp. PCC 6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 4183 - protein, 504 aa, Bixa orellana
MESTGRAPLGNGRIGNPGGLVVPEIKFTKLFINGRFVDNVSGQTFDTRDPRTGDVLATIAEADKDDLDLAVKNAREAFDHGPWPRMSGYERARIMTKFADLVEAFIEELAALDTADAGKTLSMGKAVDIPAAVQIMRYYAGAADKLHGQPLKMNQDTQGYTLKDPIGVVGHIIPWNYPTMMFFLKNAPALAAGCTMVVKPAEQTPLSALFYAHLARMAGVPDGVVNVVPGFGPTAGAAVSSHMDVDSVSFTGSQEVGRAIMRAAAQSNLKNVSLELGGKSPVIIFDDADVDMAVSLSQLACFTNKGEICVATSRVYVQEGIYDALVKKIVEAAREWRFDTKANMGPQVDKKQFERVLKYIDLGKREGATLLTGGKTNGDKGYYIQPTIFLDVREDMNIAQDELFGPVMALMKFKTVDEAIQKANCTKYGLAAGIVTKELNLANTVSRSIRAGAVWVNCYFGFDPDAPFGGYKMSGFGKDRGVLAIDQYLKAKTVNTAIPNSPWY

SEQ ID NO: 4184 - protein, 353 aa, Cryphonectria parasitica
MGCGMSTEEKEGKARNEEIENQLKRDRMQQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 4185 - protein, 372 aa, Nicotiana tabacum
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIHRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFAELLGRKPVFPGTECLNQLKLIINILGSQREEDIEFIDNPKARKYIKSLPYSPGTPFSRLYPHAHPLAIDLLQRMLVFDPSKRISVIEALQHPYMSPLYDPNTDPPAQVPINLDIDEDLGEETIREMMWSEILEYHPEAATAAMEVVL

SEQ ID NO: 4186 - protein, 463 aa, Corynebacterium glutamicum ATCC 13032
MAKSNEGLGTGLRTRHLTMMGLGSAIGAGLFLGTGVGIRAAGPAVLLAYIIAGAIVVLVMQMLGEMAAARPASGSFSRYGEDAFGHWAGFSLGWLYWFMLIMVMGAEMTGAAAIMGAWFGVEPWIPSLVCVVFFAVVNLVAVRGFGEFEYWFAFIKVAVIIAFLIIGIALIFGWLPGSTFVGTSNFIGDHGFMPNGISGVAAGLLAVAFAFGGIEIVTIAAAESDKPREAISLAVRAVIWRISVFYLGSVLVITFLMPYESINGADTAAESPFTQILAMANIPGTVGFMEAIIVLALLSAFNAQIYATSRLVFSMANRQDAPRVFSKLSTSHVPTNAVLLSMFFAFVSVGLQYWNPAGLLDFLLNAVGGCLIVVWAMITLSQLKLRKELQANDEISTVRMWAHPWLGILTLVLLAGLVALMLGDAASRSQVYSVAIVYGFLVLLSFVTVNSPLRGGRTPSDLN

SEQ ID NO: 4187 - protein, 423 aa, Methanocaldococcus jannaschii [sequence omitted]

SEQ ID NO: 4188 - protein, 340 aa, Zea mays
  unsure (1)..(340): unsure at all Xaa locations
MRPSLLKSTAELLRRSRGYXSTANPERKVAILGAAGGIGQPLSLLMKLNPLVSSLSLYDIAGTPGVAADVSHINSPALMKGFMGDDQLGEALEGSDIVIIPAGVPRKPGMTRDDLFNINAGIVKALCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNDFEKKGLESLKVELKSSIEKGIKFAHGN

SEQ ID NO: 4189 - protein, 238 aa, Glycine max
  unsure (1)..(238): unsure at all Xaa locations
MVKAKQSQVWLRKSWWRVSWPGTLTLLLLLTCSFLILIPLALRILSTPHVNSSSALSKPNDLNSVPRNTHVSEGENNRVKRWVEVMSWEPRAFLYHNFLTKEECEYLINTATPNMLKSLVIDNESGEGIETSYRTSTEYVVERGKDKIVRNIEKRIADVTFIPIEHGEPLHVIRYAVGQYYEPHVDYFEEXFSLVNGGQRIATMLMYLSXVERRGETVFPIANANFSSVPWWNELSEW

SEQ ID NO: 4190 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHSVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 4191 - protein, 209 aa, Escherichia coli O157:H7
MSQFKEFASVSDKQLGFFIDSSRCSGCKACQVACKDKNNLEVGRRFRRVYEVNGGGFIATGEGGVSHNVFAYTLSVSCNHCADPICTKNCPTMAMHKRPGDGIVRVNTDKCVGCGYCAWSCPYGAPQMNEQTGQMSKCDFCIDLQAKGEQPICVATCPLGAIKFGPIDELREKYGDVSDVKGLPDSSITQPNLVIKPHQGAEKEASHHA

SEQ ID NO: 4192 - protein, 63 aa, Brassica napus
MRGILADWLVEVSEEYTLVPDTLYLTVYLIDWFLHGNHIERQNLQLLGITCMLIASKYEEIYP

SEQ ID NO: 4193 - protein, 153 aa, Frankia sp. FE141
ITREEYSRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVAL

SEQ ID NO: 4194 - protein, 409 aa, GIBBERELLA ZEAE PH-1
MLSRALRLPRAVPMRTKLAAPAYTAVRSVTTDAASASLSHSVPKADDEPFSVNLSDESFETYELDPPPYTLEVTKKELKDMYREMVVTRQMEMAADRLYKEKKIRGFCHLSTGQEAVAVGIEHAITKEDDIITAYRCHGYALLRGASVRSIIGELLGRREGISYGKGGSMHMFAKGFYGGNGIVGAQVPVGAGLAFAHKYNNNKNASIILYGDGASNQGQVFEAFNMAKLWNLPALFGCENNKYGMGTAAARSSALTDYYKRGQYIPGLKVNGMDVLAVKAAVKYGKEYTAADKGPLVLEYVTYRYGGHSMSDPGTTYRTREEIQRMRSTNDPIAGLKQKILDWEITTEEELKKIDKEARAHVNEEVAAAEAMAAPEAKPEILFEDIYVRGSEPEYIRGRIPEENHYFQ

SEQ ID NO: 4195 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQKVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 4196 - protein, 489 aa, Escherichia coli O157:H7
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 4197 - protein, 456 aa, Asteronema ferruginea
YNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLSGGLDFLKDDENINSQPFMRWKERFLYCMEGVNRSAAATGEVKGSYLNITAATIEQMYERAEYAHAIGSVIVMVDLVIGYTAIQTMAIWARKAEMILHLHRAGNSTYARQKNHGINFRVICKWMRMCGVDHIHAGTVVGKLEGDPLMVRGFYNSLLLTHLKINLAEGLFFDMDWASLRKCVPVASGGIHCGQMHQLLYYLGDDVVLQFGGGTNGHPDGIQSGATANRVALEAMVLARNEGRDYVGEGPEILRNAASTCGPLKAALDLWKDITFDYTSTDTPDFVEVATGTN

SEQ ID NO: 4198 - protein, 184 aa, Nostoc punctiforme
MQYLGELAAEFSVADDIKVFRNDKISIDEIRALKPEAVVISPGPGRPEDAGISLELIEQLGQELPILGVCLGHQSIGQVFGGKIIPAPELMHGKTSQVSHTGVGVFRGLENPLIATRYHSLVIERETCPDVLEITAWVEDNTIMGVRHRNYPHIQGVQFHPESVLTSSGKQLLRNFLEQLQSRA

SEQ ID NO: 4199 - protein, 115 aa, Thermoplasma volcanium
MSDDEELEKIRRRQMEELQRQAMQRQMAEEEEKQREIEKARRQQILRQILDPSARERLNNVRLVRPDLADNVENQLIQLASMGRINRIIKESDIIDILSKLTENKREPKIERRSK

SEQ ID NO: 4200 - protein, 710 aa, Methanosarcina mazei Goe1
MDKKMINEKSKEEQLEKFHEDPEREFLTTNQGVRVNNTDISLKAGERGPTLLEDFHFREKLTHFDHERIPERVVHARGSGAHGFFQVYEPMTEYTSAKFLQDPNKKTPVFVRFSTVVGFRGSADTVRDVRGFAVKFYTEDGNYDLVGNNMPVFFIQDAIKFPDLVHAIKPEQDNQIPQASAAHDTFWDFVSCHHENAHMIMWVLSDRALPRSYRMMEGFGVNTFRFVNAEGKGRFIKFHWKPMLGIHSLVWDETQKIAGKDPDFNRRDLWDAIEMGAYPEFELGVQILEEEDEFKFDFDILDPTKLWPEEDVPIKWIGKMTLDRNPDNFFAETEQVAFCPANVVPGIDFSNDPLLQGRLFSYLDTQLIRLGGPNFQEIPVNRALAPVANNQREGYNRMTINKGKTSYFPNTVGDGKPRPASAEEGGYVHYMEKVEGKIIRSRSEKFKDFFSQAKLFWNSMSQPEKEHIIEAFHFEIGKVKDKKIRQAVVDMFNNVDGDLAVEIAKGVGVSAPAQKGGSPVAKESPNLSQERSERNVKNTIKTRKIAIIVADGYDHKDLSQVMQALEAGGARADIISKFQGMLKSSDGQEIEVDKNYRTTESVLYDAVYIPGGKENVETLKKHGDAIHFVNEAFRHCKPLGATGEGVELFKAAHLPDIKLAGKSSADKVVSDKGVVTARNEGDRSSFNESFTIAIAQHRHWNREKKEQVPA

SEQ ID NO: 4201 - protein, 645 aa, Glycine max
MAAITAPKAAFSVLPSSSHSPNPFVRFAIPYSPHHSQRRSLRISSALSDATTKSSTAAAEAFASRFGLDEPRKGADILVEALERQGVTDVFAYPGGASMEIHQALTRSSSIRNVLPRHEQGGVFAAEGYARSSGLPGVCIATSGPGATNLVSGLADALLDSVPLVAITGQVPRRMIGTDAFQETPIVEVTRSITKHNYLVLDVDDIPRIVNEAFFLATSGRPGPVLIDIPKDIQQQFAIPNWDQPIRLPGYMSRLPKSPNENHLELIVRLVMESKKPVLYVGGGCLNSSEELRRFVELTGVPVASTLMGLGAYPIADENSLQMLGMHGTVYANYAVDKADILLAFGVRFDDRVTGKLEAFASRAKIVHIDIDSAEIGKNKQPHVSVCADLKLALKGINRVLESRGVAGKLDFRGWREELNEQKRRFPLSYKTFEKEISPQYAIQVLDELTNGEAIVSTGVGQHQMWAAQFYKYKRPRQWLTSGGLGAMGFGLPAAIGAAVANPGAVVVDIDGDGSFMMNVQELATIKVEKLPVKILLLNNQHLGMVVQWEDRFYKSNRAHTYLGDPSNENAIYPNMLKFADACGIPAARVTKKEDLRAAIQKMLETPGPYLLDVIVPHQEHVLPMIPSNGTFQDVITEGDGRTSY

SEQ ID NO: 4202 - protein, 257 aa, Glycine max; identical to SEQ ID NO: 3747

SEQ ID NO: 4203 - protein, 471 aa, Chondria dasyphylla
  unsure (1)..(471): unsure at all Xaa locations
SGVIPYAKMGYWDPDYAVKDTDVLALFRVTPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKDLGTVIIMIDLVIGYTAIQTMAIWARRNDMILHLHRAGNSTYSRQKIHGMNFRVICKWMRMAGVDHIHAGTVVGKLEGDPLMIKGFYDTLLVPYLAVNLPQGIFFEQDWASLRKVTPVASGGIHCGQMHQLLDYLGIDVVLQFGGGTIGHPDGIQAGATANRVALEAMVIXXXXXXXXXTEGPQILRDAVKTCGPLQTALDLWKDITFNYTSTDTADFVETPTANV

SEQ ID NO: 4204 - protein, 486 aa, Corynebacterium efficiens YS-314
MAMSEVPAAAQPGAAPGSSETTSDPNRRQELGTGLRTRHLTMMGLGSAIGAGLFLGTGVGIRAAGPAVLLAYIAAGVIVVLVMQMLGEMAAARPHSGSFSKYAEDAFGHWAGFSLGWLYWFMLIMVMGAEMTGAAAIMGAWFGVDPWIPALVCVVFFAIVNLAAVRGFGEFEYWFAFIKVAVIVVFLIVGVGLIFGLLPGSTFVGTSNFIGDHGFMPNGLSGVAAGLLAVAFAFGGIEIVTIAAAESDQPRRAISLAVRAVIWRISLFYLGSVLVITFLMPYESIDNAETAAESPFTRILDMANIPGAVGLMEAVIVLALLSAFNAQIYATSRLVFAMSRNQDAPRVFSVLSRSGVPTAAVLLSMFFAFVSVALQYFNPAGLLDFLLNAVGGCLLVVWAMIALSQLRLRPKLEHNGEISTVRMWGHPWLGILTLVLLAGLVLLMLGNEGSRSQVFSVAVVYGFLVALSFTTTRSPLRGKRTGLIDR

SEQ ID NO: 4205 - protein, 323 aa, Zea mays
MSASRPDHRRRHPPFLRDLSSPISSSFRLPPASMRREAQASTPPPPPPLLSLDDLSHLSPSRQPATPPQATTTPSPQPPRGAVLFSSPLRSNGSPGPSAWWTPSREENPREGSPMDGVVQYQQQSPTTPSGQQSQQQKVALITLPPPREVARPEMPRDSAPAAGRVDEEEWVTVFGFFPGDTNMVLREFEKCGIVLRHVLGPRDANWVHILYQSRHDAQKALAKHGQQLNSVLIIGVKPVDPWQLQYLNENTNENYQGSATATFTSQPVAPSGFATRNALAPLPSNTLTNGSCNDSSNLGASGAVASPTKSVLSKVMDLMFGL

SEQ ID NO: 4206 - protein, 456 aa, Oryza sativa
  unsure (1)..(456): unsure at all Xaa locations
VVLELRSELYNDPYDEIDWNKARTQCAKEDMYYPRSSKLDMFWSFLHKFIEPVLLRWPGRKLREKALATSMRNVHYEDECTRYICFGGVPKALNILACWIEDPSSEAFKCHIARVYDYLWIAEDGMKMQXQIYDGSQVWDAGLTVEALVATDLVKELGPTLKRAHSFLKNSQLLDNCPRDFNRWYRHISKGGWTFTTADDGWQVSDCTATALKACLLLSRISPEIVGEPLEIDAQYDAVNCLMSLMNDNGGFSAFELVRSNTWLECLALFKKLHPGHRKXEVENCISKGANFIESSQRSDGSWYGSWGICFTYATWFAVTGLVSAGRTLGNSATVRKACDFLLSKQLPSGGWGESYLSCHDEVYTNLKGNRPHGTHTAWAMIALIDAGQAERDPVPLHRAAKALXNLQLEDGEFPQQEIVGVFLQTAMISYSQYRNIFPIMALTGYRRRVLLAGNI

SEQ ID NO: 4207 - protein, 115 aa, Triticum aestivum
AEILRGHGGPSLGFVKLRAGDRRAGAGVGGIATRWSNVLRTGSVAAKFVAVDFGTLMFTMERGRDMRELKEFILGQPEAYEFKVGDQFFRRPGDPPLDQVIQMLRKHKDKSEDEL

SEQ ID NO: 4208 - protein, 543 aa, Glycine max
MVESQPKFFIPDSINGVNFDVAAQIKMVWEVIKAPLIVPLLNLAVYISLAMALMLFMERVYMGIVIILVKLFWKKPHQRYKFEPLQDDEELGNSNYPVVLVQIPMFNEKEVYKVSIGAACNLSWPVDRLVIQVLDDSTDPTIKQMVEMECNRWASKGINIVYQIRETRGGYKAGALKEGLKRNYVKHCEYVAIFDADFRPEPDFLRRSIPFLVGNPDIALVQARWRFVNSDECLLTRMQEMSLDYHFTVEQEVGSATHAFFGFNGTAGIWRIAAINEAGGWKDRTTVEDMDLAVRASLRGWKFLYLGDLQAKSELPSTLRAFRFQQHRWSCGPANLFRKMVMEIVRNKKVKFWKKVYVIYSFFFVRKIIAHMVTFFFYCVVIPLTILVPEVHVPIWGAVYIPSVITILNSVGTPRSIHLLFYWILFENVMSLHRTKATFIGLLEYGRANEWVVTEKLGDSVNNNNKNKSGDAAKKNNAIKATPKKTRSKFVERLNLLELGFAVFLFVCGCYDYVHGKHNYFIYLFLQTLTFSIVGFGYVGTIV

SEQ ID NO: 4209 - protein, 317 aa, Actinidia deliciosa
TFPVIDMEKLTGKERSPTMEKINDACENWGFFELMNHGISHELMDTVERLTKEHYKKCMEQRFKEMVATKGLEAVQSEIDDLDWESTFFLRHLPVSNISEIPDLEQDHRKAMKEFAEKLEKLAEQLLDLLCENLGLEKGYLKKAFSGSKGPTFGTKVSNYPPCPLPELIKGLRAHTDAGGIILLFQDNKVSGLQLLKEGEWIDVPPMKHSIVINIGDQLEVITNGKYKSVMHRVIAQTDGNRMSIASFYNPGSDAVIYPAPALVDKEEDQQKQVYPKFVFEDYMKLYAGLKFQAKEPRFEAMKAMESAVKLGPISTI

SEQ ID NO: 4210 - protein, 193 aa, Zea mays
  unsure (1)..(193): unsure at all Xaa locations
MGNPEKLMNQIFDLKFTSKSLQRQARKCEKEEKEQKLKVKKAIEKGNMDGARIYAENAIRKRTEHMNYLRLXTQAKMQVIGKSMQSIVKSLDSALATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 4211 - protein, 504 aa, ASPERGILLUS NIDULANS FGSC A4
MRLSPAWYQFLVGVFASLGSFLYGYDLGVIAEVIACESFKTTFKEPDSTQTGLVVSMFTVGAFCGAAFAGPTGDYLGRRWTIIIGCIVFCLGGGLQTGAQTIEYLYSGRFFAGVGVGFLTMIVPLYQAEICHPNIRGRVTALQQFMLGVGALCAAWISYGTYVGFDDTNDAQWQVSLGLQIVPAVFLGLLIMLFPESPRWLIDHGRQEEGLKTLARLHAYGDVNDAWVRAEYTQIQEFILREHEEEAKSYLELFQSRSSFRRLFLCCALQASVQMTGVSAIQYYSVTIYAQIGISGDETLRYQAINSIIALIAQFLCMMLIDRFGRRWSLISGNLGNCLTFIIACILLARFPPEVNNTGAHWGFIIMTWLYNFSFSCTCGPLSWIIPAEVFDTRTRSKGVSLATMTSYAFNTMIGQVTPLAMEDVGYRYYYLFIICNFTNAVFFWLLLPETKKLPLEEMNYLFSNAPWIIPGTKKEDYVPHDLERRVVEQEEKQHAYASHEEKK

SEQ ID NO: 4212 - protein, 181 aa, Arabidopsis thaliana
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 4213 - protein, 203 aa, Yarrowia lipolytica
MSHSQRTYDLLIKLLLIGDSGVGKSCLLLRFCEDQFTPSFITTIGIDFKIRTIDIGNQRVKLQVWDTAGQERFRTITTAYYRGAMGILLVYDVTDEKSFNNIENWYQNVQTYANEGVELILVGNKCDLDEKRVVSTEQGQALADKFGIPFLEASSKTNINVEECFYSVATRIRDTVAKTKGNESGSGGINIAEGEENSASKCC

SEQ ID NO: 4214 - protein, 371 aa, Nicotiana tabacum
MANEENKAAPTNTSRASNKRAFDDTLAAASSNGNDPLLKRVVLGELTNLEYVVGSTKTNTHNSKHKIKLKKTAPTKRKKIAIQSFKSDAATNFSPNDDLQKCAYAPLIYQHLHSLEVEARRRPLSNYMEKVQNDVTPTMRMILVDWLVEVADEYKLVSDTLYLTVTFVDRFLSSHVMARNSLQLLGVSCMLVASKYEEISPPHVEDFCYITDNTYTGEEVVNMERDLLNFLNFEISNPTTKTFLRIFTKVSQDNVDFLTLHFEFLGCYLAELSLLDYSCVRFLPSAVAASAIFLSRFTLLPKVHPWNLALQHCTGYKPSELKDCVLVIHELQSGRRAASVQAVRKKYMDHKYKCVAALHPPDIPACFFDDA

SEQ ID NO: 4215 - protein, 172 aa, Pyrobaculum aerophilum str. IM2
MAHEHHRRQGPSTARFYIITVSTSRYREKMSGGSPRDESGDLAVEMAREAGHEVVGRDLIPDDMYVIRRRILELVSRDDLDVIVLTGGTGLTKTDVTIEAVRPLFEKEIEGFGDVFRYFSVQEVGAAAFLTRATAGVINGKAVFLLPGSPNAVKTGMKIILQEISHLLYLIK

SEQ ID NO: 4216 - protein, 245 aa, Oryza sativa
  unsure (1)..(245): unsure at all Xaa locations
MRTASTATRRVSAGAPLPTSLPFSSSPSRQPGMGFPVCCYXSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSICRHVFHRGCLDRWMEHDDQRTCPLCRAPLIPDEMASALWAAAGVPDASDFDFSYFGAPLTPMPTPTLLRPHELLLTGLGGYQ

SEQ ID NO: 4217 - protein, 748 aa, Arabidopsis thaliana
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDANKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQEILGVFNRNCMISYSAYRNIFPIWALGEYRKLMLSL

SEQ ID NO: 4218 - protein, 127 aa, Oryza sativa
  unsure (1)..(127): unsure at all Xaa locations
MDPCKFRPESSFDTKTTTTNAGAPVWIDSQALTVGPRGAILLEDYHLIEKAAHFARERIPERVVHDRGVYAKGFFECTHDLTDITXADFLRCQGAQTPDMGRLYTVMHERGSPETIRDPRGFAVKCY

SEQ ID NO: 4219 - protein, 225 aa, Populus tomentosa
MAREKIKIKKIDNVTARQVTFSKRRRGLFKKAEELSVLCDAEVAVIIFSATGKLFEYSSSSMKGVLARYNLHSNNLDKINQPSLELQLENSNHMRLSKEVSEKSHQLRRMRGEDLQGLNIEELQQLEKALEVGLSRVLETKGERIMNEISTLERKGVQLLEENKQLKQKIATITRGKRPALVDLDTAVQEEGMSSESTTNVCSCSSGPPVEDDSSDTSLKLGLAI

SEQ ID NO: 4220 - protein, 364 aa, Zea mays
MELSPNNSTDQSLLDAQLELWHTTFAFMKSMALKSAIHLRIADAIHLHGGAASLSQILSKVHLHPSRVSSLRRLMRVLTTTNVFGTQPLGGGSDDDSEPVYTLTPVSRLLIGSQSSQLAQTPLAAMVLDPTIVSPFSELGAWFQHELPDPCIFKHTHGRGIWELTKDDATFDALVNDGLASDSQLIVDVAIKQSAEVFQGISSLVDVGGGIGAAAQAISKAFPHVKCSVLDLAHVVAKAPTHTDVQFIAGDMFESIPPADAVLLKSVLHDWDHDDCVKILKNCKKAIPPREAGGKVIIINMVVGAGPSDMKHKEMQAIFDVYIMFINGMERDEQEWSKIFSEAGYSDYRIIPVLGVRSIIEVYP

SEQ ID NO: 4221 - protein, 122 aa, Glycine max
  unsure (1)..(122): unsure at all Xaa locations
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 4222 - protein, 525 aa, Neurospora crassa
MENCKLLLSGLQKRWPETVSLTGLRCRIPVENPATGEIVAHCHSASKEDVVSAVELAHDTYKSGVWSRAPRHVRAEVLERAASLFETHLAALIDIEVTQTGRAIREMNAQVPSLVKWFRYYAALLRTEERSVLPTVGKLHNFLDRRPLGVVVQITPFNHPLLIAVKKLAPALAAGNSVLLKPSELTPITSLMLGKIMKEAGLPDGVLSVLPGYGATTGKALVEHPLVKKVDVTGGTAAGRAIGEIVGRNLAKYTAELGGKAPLVVFQDADLDAAVNGIAFGAFIASGQTCVAATRIIVHESIYSEVLQKLTTRATSIERRMGSPKNPECMMGPLISERQLKNVEELVDEACLYHERIVQAGGNRLEGRSELDDTDFSKGYYFPPTILAYNKPKDRSILNARIWREEAFGPVVVVVGFSTEEEAIELANDSEFGLGAAIWTRDLAQAFRVSEQIDAGIVWVNTHHRNDPSSPWGGAKSSSGVGSENGIDAYHAYTKTKSTIINYASAEEMAAEDWFKEGAGTVRYG

SEQ ID NO: 4223 - protein, 469 aa, Porphyra schizophylla
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPIAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTEINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANV

SEQ ID NO: 4224 - protein, 458 aa, Oryza sativa
MGLVYFWAATATRRWWPICVMSSTARPHGDVTVPDPAGGPHLPGAHNSRHDELYLWGVREVVVLLRPSAIAADRSIRSHSFSDAGDGRFPPGGVEPETPPGSSSGGSTPVGGKPPRHHLTSIRHCASSARIAAATAEFDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 4225 - protein, 869 aa, Cellvibrio japonicus
MKDDFPQRLLRVSAASLLVLAALAGCDSRAPSTTDSTTTVSADTVTTQATEKVEWPVLNSAIKKDPAVEARVDDLLARMTLEEKIGQLVQPEIRHVTPEDIKQYHVGSVLNGGGSTPGANKYASLEDWVKLADSFYYASVDKSDGRIGIPVIWGTDAVHGLGNVIGATLFPHNIGLGATNNPELLKQIGWATAREIAATGLDWDFSPTVAVARDDRWGRTYESWSEDPQIVHAFAGKMVEGLQGTGGSDRLFTHEHVIATAKHFIGDGGTLNGVDRGETQGDEKVLRDIHGAGYFSAIESGVQVVMASFTSWEGTRMHGHKYLLTDVLKDRMGFDGLVVGDWSGHSFIPGCTALNCPQSLMAGLDIYMVPEPDWKELYKNLLAQAKTGELPMARVDDAVRAILRVKIRAGLFEKGAPSTRPLAGKKDVLGAPEHREVARQAVRESLVLLKNKNNLLPLARQQTVLVTGDGADNIGKQSGGWSVSWQGTGNTNADFPGATSIYAGINAVVEQAGGKTLLSDDGSFSEKPDVAIVVFGEDPYAEMQGDVGNMAYKPRDTSDWELLKKLRSQGIPVVSLFISGRPLWVNREINASDAFVAVWLPGTEGQGIADVIFRNAQGEINYDVKGRLSFSWPKRPEQTPLNRGDANYDPLFPYGYGLSYGDKDTLGDNLSEEGIQLAEALDVLDLFNRRPIEPWQLEIIGYQNDRVPMASSTVTASSLKIQAVDRNEQEDARRVQWNGSGPGQVALSVGDRQDFIGYVKSDSALVFDIKVNAAPTVTTYLRLGCGSYCASDIDLTEKLKGFAGQDWQTVTVPLHCYPNSGANFGVTQPPEEFWTQVLQPFSLLTSGTLDVTFAQVRVVKGAGKDVACP

SEQ ID NO: 4226 - protein, 381 aa, Clostridium perfringens str. 13
MTKDELLKQRELAHGLISINPNFDINNREQLSQIYTPGVSTICKEVEHHHNMVKTLTSVGNSIAVITDGTAVLGLGNIGTLAGYPIVEAKALVYKDLAGVNAIPLCVDQIGCNELIKTIKSISPSFSGIHLEDIKAPECFYIEEELKKTLNIPVYHDDQHGTAIAVLGALYNGAKVVNKDFLKLKVLILGAGASGIATAKLLLKAGIEDIILVDKNGALVNGDETLNAPQKEMAKITNKEFKKGTLKEVIKGRDVFIGLSEGNLVTKEMVESMNEDPIIFALANPTPEIKPEIAKEAGARVIATGGPSYPNQINNILVFPGLFKGLLEAKATDVTCDVMIAVGKKLASLVENPTAEKIIPGVFDGDIVKSVSETVVKNIEN

SEQ ID NO: 4227 - protein, 620 aa, Burkholderia fungorum
RKSCLQTLLSVCFFARENPWFRCRGGVQPLNYAPRVGCTCLEWTVAQARASPVSSATSDVTRCRHGFAANLHGAGLGAETPAPADTGEDVKSSIQRNIGPFALMLTGLGSIIGSGWLFGAWKAAKIAGPAAICAWVIGAVVILAIALTYAELGAMFPESGGMVRYARYSHGALVGFISAWANWIAIVSVIPIEAEASIQYMSTWPYPWAHALFVDGSLTTHGLLLSAALVIIYFLLNYWGVKLFARANSAITIFKFLIPGATILGLMLTGFHKENFGEVSTFAPYGWSAVLTAVATSGIVFAFNGFQSPINLAGEARNPARSVPFAVIGSILLALVIYVLLQIAYIGAVNPSDVMKGWSHFNFASPFAELAIALNLNWLAILLYVDAFVSPSGTGTTYMATTSRMIYAMERNNTMPKMFGNVHPFYGVPRPAMWFNLLVSFIFLFFFRGWSSLAAVISVATVISYLTGPISLMSLRRAATDLERPLHIPGMKIIAPFAFVCASLILYWAKWPLTGEIILLMVVALPVYFYFQAKSGFAGWGRDLKAAWWLVAYLPVMAILSLIGSKQFGGHDLIPYGWDMLVVIAFSLVFYYWGVNSGYRSEYLDERQEHDEVLEGIGAH

SEQ ID NO: 4228 - protein, 312 aa, Salmonella paratyphi
MKVAVLGAAGGIGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVKILPLLLQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTLKKDIQLGEDFINK

SEQ ID NO: 4229 - protein, 742 aa, Arabidopsis thaliana
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDANKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQVSKMFYIHRQVLFSLTSLIIFASYFLFRRY

SEQ ID NO: 4230 - protein, 285 aa, Brassica oleracea
STEANKAAISILVRNLAHGSELAAGEIRVLTRTVTETRTLIVEAGAIPYLRSLLKSENAVAQENAVASIFNLSIDEANRSLIMEEHDCLEPIMSVLVSGLTMRAKEIATAALYTLSSVHDYKKTIANADGCIESLALVLRNGTVRGKKDAVYALHSLWLHPDNCSLVVKRGGVSALVGALGEESVAEKVACVLGVMATESLGAESIGREETVVTGLMELMRCGRPLGKEKAIATLLQLCTLGGAVVTEKVVKTPALAVLTRKLLLTGTDRAKRKAVSLSKVCKGC

SEQ ID NO: 4231 - protein, 590 aa, Leptospira interrogans serovar lai str. 56601
MEHHSLSLLNDIALSIIFATFFSHIARITKQPLILGYVAGGLLLGPNLGLSLVINEESIELISEIGLILLLFIIGLEIDLKELARMGKSMFVLGIVQFVFCVLFGFFFFKWILANSTGRFDLLYFAIALAISSTMIVVKLLHDKFEVSTIAGRLTIGVLVLQDIWAIIFMGVQPNLQNPQILKIAGSLGIGLVLICVSFLISRFFLSKLFNAAASKPELILITSIAWCFLLCGFAEKAGLSKEMGALIAGVSIAAFPYGADVIAKLSGIRDFFITLFFVALGMKIPIPSIQILSISLIAVVFVIFSRVITVATPVYLSGKGLRAGIVTGLNLAQISEFSLVILSLGMGYGHISKELESTVLTSMILASVVSTYIILFNDPISRFILKILNMIGLKEKEDEEDQTESYITGQSKRDIVILGYFRIAQGLLEGIEREKPEWLNRILIVDFNPVFRQSLEAKGIRWAYGDLANPETLHHLGIEEAKYVICTISDMILKGTTSRRLLESLKVICHRTQPSIILTTDDVQEAEILVKSGAAHVIVPGRISGMSLFKEMKTIVDHSKRSLESQTSSVKKKKTMKKKVSSTSKIKVK

SEQ ID NO: 4232 - protein, 129 aa, Triticum aestivum
  unsure (1)..(129): unsure at all Xaa locations
PTVMASSATSVAPFQGLKSTAGLPVSRRSNGASLGSVSNGGRIRCMQVWPIEGIKKFETLSYLPPLSTEALLKQVDYLIRSKWVPCLXEFKQVGFIFRXEHNXTPGYYDGRYLDMXELPMFXGCTDPTQ

SEQ ID NO: 4233 - protein, 502 aa, Mentha x piperita
MYSIAFMLVLRKMDEIISHTLAFQALVSLILLISITKWLSNSPKNKNSSPPSPRKLPILGNLLQLGSLPHHNLRSMARKHGPIMLLHLGSVRPVSSRRRPRGNHENSRSRLRRPRGSRSAALQLQGRVGGYGEYWRQLKTICVVQLLSNKRVQSFRSVREEETELLMKKIGDSSGNVNLSHMFTQLTNDVVCRSAIGRKYGAGDENGEKFLEILREFLELLGAISIGDFVPSLWWINRINGFDRRVDRIAKEMDEFLEKVIHERLENPAAKAEENFVDILLEIYRNNSAGVSIDRDSIKAIILDVFAAGTDTTAVVLEWAMTELLRHPEIMKKLQSEVRQVVKDKHNITDDDIEKMHYLKAVMKETMRFHTPIPLLVPRVARNDVEVMGYDVPVGTMVMINAWAIGRDPTSWDEPEKFRPERFLNSSVDFKGLDFELIPFGAGRRGCPGTTFPMATLEFTLANLMQKFDWELPHECRELDMSERPGVAIRRVIPLLAIGTKM

SEQ ID NO: 4234 - protein, 427 aa, Batrachospermum boryanum
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSIEGVNRAQAAAGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDINLPQGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 4235 - protein, 72 aa, Zea mays
LRIRIQLNTKGSDMYRSFHPEATILSDLTNAPLLSPEALVVNALDKPRAMLDNMMRNCKGLCPANNMRLEYK

SEQ ID NO: 4236 - protein, 488 aa, Listeria monocytogenes EGD-e
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREVRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGMLPSEDRLLQGRLFSYSDTQRHRVGPNYLQLPINSPKAPVANNQRDGHMPFKQQTSSINYEPNSYDTEPKENPAFIEPEQEIRGDISGRLIAEKPNNFGHAKEVWDRYSNAERAALVKNIVDDWSQVREDIKIRNLRNFYQVDPEFASRVAAGTGINLEEHVTDLK

SEQ ID NO: 4237 - protein, 691 aa, Mycobacterium tuberculosis H37Rv
MTDDERFSLLVGLTGASDLWPVRDERIPQGVPMCAGYVPGIPRLGVPALLMSDAGLGVTNPGYRPGDTATALPAGLALAASFNPVLARSSGKAIGREARSRGFNVQLAGAINLARDPRNGRNFEYLSEDPLLSATMAAESIIGIQQQGVIATTKHFSLNCNETNRHWLDAVIDPDAHRESDLLAFEIVIERSQPGAVMAAYNKVNGDYAAGNDHLLNDVLKGAWGYRGWVMSDWGGTPSWECALAGLDQECGAQIDAVLWQSEAFTDRLRAAYADGNLPKGRLSDMVRRILRSMFAVGIDRWKPAPAPDMNAHNEIAAQMARQGIVLLQNRGLLPLAPESAGRIAVIGGYAHLGVPAGYGSSAVTPPGGYAGVIPIGGSGLAAGLRNLYLLPSSPLSELRKRLPNAQFEFDPGINPAEAVLAARRADIAIVFAIRAEGEGFDSADLSLPWGQDALIAAVASANANTVVVLETGNPVTMPWRDSVNAIMQAWYPGQAGGQAVAEIVTGQVNPSGRLPITFPVDLGQTPRSQPPELGAPWGTSTTIHYTEGADVGYRWFASTNQTPMFAFGHGLSYTSFEYRDLVVTGGHTVHASFSVTNTGDRSGADVPQLYMIAAPGESRLRLLGFERVELEPGQTRRVRIEADPRLLARYDGEARSWRIEPGGYTVAVGASAVALKLAAKVKLAGRGFGR

SEQ ID NO: 4238 - protein, 299 aa, Methylobacillus sp. 12S
MRQKNVTKAVFPVAGLGTRFLPATKANPKEMLPVVDKPLIQYAVEEAVAAGITDLIFITGRNKRSISDHFDMAYELENELERNGKKQLLSVVQNIVPKNVNCIYIRQNQALGLGHAVKLAKPVVNDDPFAVILADDLIDAKVPVVKQMVDAYQYYRCSLLGVQEVPRDQTKSYGIVATHPMSNGIEQVAGIVEKPKPEEAPSNLGVVGRYILTPRIFHHLENLQAGSGGELQLTDAIASLLSEEQILAYRFEGTRYDCGSKSGFLEATVRLGLKHPECGKDLRALLEAIAAEGLVGKKK

SEQ ID NO: 4239 - protein, 402 aa, Dechloromonas sp. RCB
MLSFEQALEKLLAAAQPVEEIRSLPITAAAGRILAASQQSTVAVPPLDNSAMDGYAVRVADITAAGLCLPVSQRIPAGTVGTTLQPGTAARIFTGAPIPAGADAVIMQERCEHGENGVVINHVPREGENIRRAGEDISVGAEILKAGVKLRPQEIALAAAAGLPELPVYRRVRVGVFFTGDELVQPGEPLPPGAIYNSNRYALRALLEGMGCEVRDLGAVADTLEATRDALRRAAADNDLVLTSGGVSVGEEDHVKPAVEAEGSLNMWKIAIKPGKPLAFGEIRKSEGKAWFLGLPGNPVAAFVTFLTMVRPFILRLQGASAVTPRVLKLSSASVWSKADGARLEFLRGWLNDDGAVELYKNQGSAVVTSLCWSDGLVLNPPGNTIAVGDTLSFISFAELLS

SEQ ID NO: 4240 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEGEAPK

SEQ ID NO: 4241 - protein, 363 aa, Escherichia coli O6
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 4242 - protein, 204 aa, Thermus thermophilus
MAANGAKGRKVMRVLVVDNYDSFTYNLVQYLGELGAEPIVWRNDRFRLEEVEALDPDRILISPGPCTPFEAGLSVPLVQRYAPRYPILGVCLGHQAIGAAFGGKVVPAPVLMHGKVSPIHHDGTGVFRGLDSPFPATRYHSLAVVEVPEALVVNAWAEEAGGRTVMGFRHRDYPTHGVQFHPESYLTEAGKLILKNFLEDPWTR

SEQ ID NO: 4243 - protein, 551 aa, Oceanobacillus iheyensis HTE831
MQRYREIVVAFSRNGFGYIVKELGLHKISSLPKRLFEQGDREVHNKTTGERIRLFLEELGPTFIKLGQIASTRQDLIPKDIIEELEKLQDQVAPFSFSDVKEIIDKELQEPIDVVFESFDEDPIAAASIGQVHYGVLRTGQEVAVKIQRPNLEEKVHTDLEILMNIAKLAESRLDWAKKYQLCAIIKEFSNSLTAELDYTLEGRNAHRIAQQFKKHDDVVVPNVYWDLTTEKVLTMEYIKGIKLDENTKLVREGYNPKLIAEKLIQKQFQQILIDGFFHADPHPGNVMVLPNHKILFMDFGMVGRLTATMKDHLSSLIVAIMRQNTKSIIKAIYRMGIVSEGVDADYMYADIDDLRDKYYDIPFSQVSIGEAINDLFRVATTHGIRIPTDLSLVGKSLLTLEGTVERLDPDISIVKIAEPFGKRLLREKYQPKKVADEVYQQAEDYKDLILDFPDHINHLYKVIRRGKLPLEISVSRVEAFLKKLDRISNRLSFSIVLLAFSIIMVGLIIGSALAGESSYLWSLPVIEIGFVVAIGMFLWLLYSIFRSGRF

SEQ ID NO: 4244 - protein, 290 aa, Actinobacillus actinomycetemcomitans
MKGIILAGGSGTRLYPITRGVSKQLLPVYDKPMIYYPLSVLMLAGVRDILIITTPEDNESFKRLLGDGSEFGVNLQYAIQPSPDGLAQAFLIGEGFINGDSCCLVLGDNIFYGQNFTQMLQQAVARPYGATVFGYLVKDPGRFGVVEFDENFKAVSIEEKPAQPKSNYAVTGLYFYDNRVVDFAKQVKPSARGELEITTLNEMYLKDGSLNVQLLGRGFAWLDTGTHESLHEGASFVRTVESVQGLQVACLEEIAWRNGWLTSEQVETLARPMVKNEYGQYLLRLINEEK

SEQ ID NO: 4245 - protein, 462 aa, Salmonella typhimurium LT2
MTMMTATQALSVNPATGQTLAAMPWANAQEIEHALSLAASGFKKWKMTSVAQRAQTLRDIGQALRAHAEEMAQCITREMGKPIKQARAEVTKSAALCDWYAEHGPAMLNPEPTLVENQQAVIEYRPLGVILAIMPWNFPLWQVLRGAVPILLAGNSYLLKHAPNVTGCAQMIARILAEAGTPAGVYGWVNANNEGVSQMINDPRIAAVTVTGSVRAGAAIGAQAGAALKKCVLELGGSDPFIVLNDADLELAVKAAVAGRYQNTGQVCAAAKRFIVEEGIAQAFTDRFVAAAAALKMGDPLVEENDLGPMARFDLRDELHQQVQASVAEGARLLLGGEKIAGEGNYYAATVLADVTPDMTAFRQELFGPVAAITVAKDAAHALALANDSEFGLSATIFTADDTLAAEMAARLECGGVFINGYSASDARVAFGGVKKSGFGRELSHFGLHEFCNVQTVWKNRV

SEQ ID NO: 4246 - protein, 460 aa, Lactobacillus plantarum WCFS1
MKITNADGTIRALSNRHVQMIAIGGTIGTGLFLGSGSTISKTGPSVMWVYLVLGFFFFLMMRAIGEMFYSDPTQHTFVAFISRYLGPSVGYFTGWTYWIGLIFVCMAELTATATYVKFWLPNVPAWLIEISFLLILAGVNLTAARLFGEAEFWFAMIKIVAIIALIITGIFMMVGHHPTPLGQASIGNLFHNYQVFPNGIANFISAFPMVFFAFQGIEFVSITIGEAKNPHRVIKKAVNETLLRILLFYIGALIVIMGIIPWTSLSPDSSPFVQVFKLAGYPAAAAIINFVVLTSAASSLNSCLFSAGRHFYQLATEMPVTSRMHQIFGQISKSGVPAAAIVLSAILVLVTPIMSLSAATTAVFTVVTGISSDMYLIVYTLAMLAHRKYRLSNDYLADGFKMPAYRITSPLTIAFFVLIFASLFFIQADIVGAIGAIIWTLLFGGITFAHQARLRAVTRS

SEQ ID NO: 4247 - protein, 450 aa, Staphylococcus xylosus
PRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 4248 - protein, 172 aa, Synechococcus sp. PCC 7942
MSQSIDLDIPKLDRIDELAQELAAIQQTSSKRVAILGSRHVPITHQHLIEMMSYALVLAGNRLMTSGAQGTNAAVIRGAMRADPNLLTVILPQSLDRQPRESREQLEKVIHLVEHAENDHLSLAEASTLCNQAIVTRCQQLICFAFHDSHTLLETCRYAEDQHHLVTLFYFD

SEQ ID NO: 4249 - protein, 255 aa, GIBBERELLA ZEAE PH-1
MEVANGSSAAQGQNGSSEGSNGYKLKFCTVCASNNNRSMEAHLRLSQADYPVISFGTGSLVRLPGPTITQPNVYHFNKTSYDSMFKELESKDARLYKNNGILNMLNRNRGVKWGPERWQDWQVGVPRLQHAKDRGSEGTEGGLVDIVITCEERCWDAVVDDLMNRGSPLNRPVHVINVEIKDNHEEAAVGGQGILDLANSLNAAAREERDAVGASAFDNGSASSRATFDERVPDILASWQERWPNLPATWTVAWF

SEQ ID NO: 4250 - protein, 70 aa, Glycine max
  unsure (1)..(70): unsure at all Xaa locations
EALLATGSNSDTGYIAHAPSESNGLSDVLIXSSPILTGVSARARGLAAAAAAAAAGGVSGFEFGVDPNLD

SEQ ID NO: 4251 - protein, 612 aa, Eremothecium gossypii
MMANRAIQYMIVMTLRMGWAAGAGNDAGGVPNEPDGQPPIDGEPDENVNPITEEIFSSWALCILLFLLIAALWTNYYLTQRRIRAVHETVLSIFYGMLTGFLIRVSPGHYIQDTVTFNSSYFFNFLLPPIILNSGYELNQTNFFSNIVSILTFAIPGTFISAVVLGVILYLWTALGLESIDISFLDALSVGATLSATDPVTILSIFNAYKVDPKLYTIIFGESLLNDAISIVIFETCQKFHGKPLTFMSFFEGIGLFLMTFTISLLIGVMVGILVALLLKHSHVRRYPQIESCLVLLIAYESYFFSNGCHMSGIVSLLFCGITLKHYAYYNMSRRTQLTIKYIFQVLARLSENFIFIYLGLALFTQVELVYKPMLIIVTAISICVARWCAVFPLSDFVNWLYRVRTMGTLRSRTAVSIPDEIPYQYQMMTFWAGLRGAVGVALAMGLQGEFKFPLLATVLVVVVLTVIIFGGTTAGMLEILNIKTGCVEEQEDTDDEFDIEAPRPVQLMSSLDAPPFLADSPTGSPDQESFPPMIDRPSSRSASGADQPVGRLSLDRRNIRETLGNILQADGQWFNKFDERVLKPVFLDNPSASPSNNNQSGSNSFIGNRRS

SEQ ID NO: 4252 - protein, 220 aa, Escherichia coli
YDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEG

SEQ ID NO: 4253 - protein, 492 aa, Suaeda maritima subsp. salsa
MDPYKFRPSSANNSPYFTANSGAPVWNNNNSLTVGHRGPILLEDYHLVEKLANFDRERIPERVVHARGASAKGFFEVTHDVSHLTCADFLRSPGVQTPVIVRFSTVIHERGSPETIRDPRGFAVKFYTREGNFDLVGNNFPVFFIRDGMKFPDMVHSLKPNPKSHIQENWRIMDFFSHHPESLHMFTFLFDDIGIPANYRHMEGSGVNTYTLINKAGKTYYVKFHWKPTCGVKSLLEDEAIKVGGANHSHATQDLYDSIASGNYPEWKLFIQTIDPADEDKFDFDPLDVTKTWPEDILPLQPVGRLVLNKNIDNFFAENEQLAFCPSIVVPGVHYSDDKLLQTRIFSYSDTQRHRLGPNYLQLPVNAPKCSHHNNHYDGFMNFMHRDEEVDYFPSRYDPVRHAERYPIPSNVLNGCREKQCIPKENNFKQPGERYRSMDPARQERFICRVVDALSDPRVTHEIRSIWISYWSQADKSLGMKVASRLNVRPTM

SEQ ID NO: 4254 - protein, 434 aa, Magnetospirillum magneticum
MELHHPELTYAAIVALAAVLCGGMMTRLKQPAVVGYILAGVVLGPSGFGLVSNRDAVATLAEFGVLMLLFVIGMKLDIIRFLEVWKTAIFTTVLQIAGSVGTALLLRHGLGWSLGLAVVLGCAVAVSSTAVVIKVLESSDELDTPVGRTTLGILIAQDMAVVPMMLVLESFETKALLPADMARVVLSVLFLVLLFWWLSKRRIDLPITARLSRDSDLATLSTLAWCFGTAAISGVLDLSPAYGAFLGGVVLGNSAQRDMLLKRAQPIGSVLLMVFFLSIGLLLDFKFIWKNLGTVLTLLAMVTLFKTALNVTALRLARQDWPSAFLAGVALAQIGEFSFLLAETGKAVKLISAQETKLVVAVTVLSLVLSPFWLFTMRRMHRVAAVHVHSFRDLVTRLYGDEARAFARTARRARVLVRRGSWRDDPNAGPGSGI

SEQ ID NO: 4255 - protein, 308 aa, Oryza sativa
RYFTEVTIILSQTGGSVAYLVFIGQNICSVFPTTAAGGAVVLAVLLPAEAALSFIRSLSSLAPFSILADACTVLAVATVVREDVQLLAGRGGSPFQGRSALAGLWGVPFACGVAVFCFEGFCLTLALEASMSDRRRFRPVLLHAIAGVTAVYVCFGVCGYLAYGDVTRDIVTLNLPNNWSTAAVKIVLCVALALTFPVMMHPIHEIVEARLFPSAGGWARKRAAVQASRVAVVGAVTAVACFVPAFGEFAAFVGSTVCALLSFLLPALFHLRLVRAAASAWRRSVDGSFLLLGLGFAVHGLYTVVSGP

SEQ ID NO: 4256 - protein, 395 aa, Corynebacterium efficiens YS-314
MSRTPEHHVEAIRALLPAPGAEMVDLHAALGRRTTTPINAVWDSPRFDNSQMDGFALTTAQLAGGTFPVGPTIAAGVDPATWYPTGLVDATLCPIMTGARLPSGTAAVIPVENTRPGEFTAPRVTIPATPAGQFLRLRASDIRAGEEIIPANTEITPVHIALLASQSITAVEVMRRLRIITVTGGAEINNSGGAATIPDANGPLLRGLAQRHGMEVLHQLHTDDHPARLAEQLEKAIDRYQPDAVITSGGISHGKFEVIRQVLEPGEGAWFGHVDQQPGGPQGLAVFHGTPVIALPGNPISTLVSFVLFLPPVLRGEPLTPVVAEMAVTATGLSGGRDQFLRGRWEVVDKRLVATPLPGTSSHLLAQAAGATCLIRVPAGTTVEAGNSVDTYPLG

SEQ ID NO: 4257 - protein, 603 aa, Achromobacter xylosoxidans
MAATDNRKVVEGVHKMTPSEAFVETCVANGVSEMFGIMGSAFMDAMDIFAPAGIRLIPVVHEQGAAHMADGYARVSGRHGVVIGQNGPGISNCVTGIAAAYWAHSPVVIVTPETGTMGMGLGGFQEANQLPMFQEFTKYQGHVCNPKRMAEFTGRVFDRAMSEMGPTQLNIPRDYFYGEIECEIPKPMRVDRGHGGEASLQAAVELLKTAKFPVILAGGGVVMGDAVEEAKQLAERLGAPVATGYLRNDAFPAKHPLWAGPLGYQGSKAAMKLIAQADVVIALGSRMGPFGTLPQHGMDYWPKAAKIIQIEADHTNLGLVKKIAVGINGDAKAVAAELSRRLADVTLGCDATKAARADTIATEKAAWEKELDGWTHERDPYSLDMIEEAKGERTPTGGSYLHPRQVLRELEKAMPARVMVSTDIGNINSVANSYLRFDEPRSFFAPMSFGNCGYALPTIIGAKCAAPDRPAIAYAGDGAWGMSMMEIMTAVRHDIPVTAVVFHNRQWGAEKKNQVDFYNRRFVAGELESESFSDIAKAMGAEGIVVDHIEDVGPALQKAIDMQMKEGKTCVIEIMCTRELGDPFRRDALSKPVRMLDKYKDYV

SEQ ID NO: 4258 - protein, 312 aa, Scenedesmus vacuolatus
NGFGRIGSLVLRATLDRKDVKVVAINDPFIEGEYMAYMFKYDSVHGRYEGDVQGDKHGITINGEQIKTLAMMDPTQIPWGEVGADYVVESTGVFTTVDKCQAHLKGGAKKVVISAPSADAPMFVMGVNADKYDPKQHTVVSNASCTTNCLAPLAKVVNDTFGIKEALMTTVHATTATQKTVDGPSKKDWRGGRGASANIIPSSTGAAKAVGKVIPELNGKLTGMAFRVPTQDVSVVDLTCILEKPAKYEDIMAALKAASEGPMKGILGYTEDDVVSSDFVSDPASSTVDAKAGIMLSPTFVKLVSWYDNEWG

SEQ ID NO: 4259 - protein, 366 aa, Triticum aestivum
  unsure (1)..(366): unsure at all Xaa locations
MRCAVVLLLVFAAARAAAVVTDGLLPNGNFESGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVIHNPGVEEDPACGPLIDAVAIRTLYPPTLSKGNMLKNGGXEEGPYFLPNASWAVLVPPNIEDDHSRLPIWTNASXYVDAAHDTXTASARAVELVGGKESALVQEVRTVPGWAYRLSFAVGDSADGCKGSMVAEAYAARSTLKVPYESNGAGGYKRAVLDFVAVRDRTRVVFQSAFYHMKADGTLCGPVIDDAKLVGLRKKPAARRLML

SEQ ID NO: 4260 - protein, 503 aa, Bradyrhizobium japonicum USDA 110
MAGSIAGAFVQGCLPKRPHHAPKKRLTMVNRMQFYIDGAWVDPAVKKSTAVVNPATEEAMYEVALGSKADVDKAVAAAKRAFATFSQTSREERVALLTKIIEIYKGRLKEIGAAVSDEMGAPLPMAEKLQAGAGLGHLMTTLDVLKNYHFEEPVGTAMVLREPIGVVGMITPWNWPLNQIACKVAPALAAGCTMILKPSEFTPTSALIFAEILHEAGVPKGVFNLVNGLGPEVGAAMSEHPDIDMISFTGSTRAGIDVAKRAAPTVKRVSQELGGKSPNVILEGADLTKAVTGGVMHMFNNSGQSCNAPSRMIVPLSKMKEVAAIAKAVADKTKAGDPRAEGTTIGPVVNRGQWDKIQGLIKKGIDEGATLVAGGPGLPEGVNKGFYVRPTIFADVTPDMTIAREEIFGPVLTIIGAKNEADAVQIANDTPYGLAGYVSADTVESAKRVARQIRAGNVNLQGVPNDRTAPFGGYKQSGNGREWGKYGLEDFLEVKAVAGFNAA

SEQ ID NO: 4261 - protein, 227 aa, Momordica charantia
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 4262 - protein, 459 aa, Lupinus luteus
MASRPVVPIHQQQVRGEGVIGGGKQKKNVAADGKNRRALGDIGNLDRVKGVEVKPNRPITRSFCAQLLANAQVAAAVENNKKLAIPNVGGAKPNVVEGAVAKRVAPKPAEKKVVEKPKPREAVEISPHEEVQKNKSVVKKKEGGENKKKPQTLSSVLTARSKAACGLTKKPQEQIIDIDANDSGNELAALEYIEDIYKFYKLEESESRPHQYLDSQPEINERMRAILVDWLIDVNNKFDLSLETLYLTINIVDRFLAVKVVPRRELQLLGISAMLLASKYEEIWPPEVNDFVCLSDRAYTHEQILVMEKIILGKLEWTLTVPTPYVFLVRFIKASVPDQELENMSHFLSELGMMHYSTLMYCPSMVAASAVFAARCTLNKTPFWNETLKLHTSYSEEQLMDCAKLLVSFHSTIGGGKLKVVHRKYSDPQKGAVAVLPPAKYLMPESSSSGTRVSKGLDK

SEQ ID NO: 4263 - protein, 226 aa, Triticum aestivum
MVVSPKIAPSMLSSDFANLAAEAKRMVDLGADWLHMDIMDGHFVPNLTIGAPVIESLRKHTSAYLDCHLMVTNPMDYVEQMGKAGASGFTFHVEVAKENWQELVSKIKSAGMRPGVALKPGTPVEEVYPLVEGETPVEMVLVMTVEPGFGGQKFMPNMMDKVRALRQKYPTLDIEVDGGLGPSTIEAAAAAGANCIVAGSSVFGAPESGKVISLLRTSVEKAQPTT

SEQ ID NO: 4264 - protein, 411 aa, Campylobacter jejuni subsp. jejuni NCTC 11168
MNLKEEALKYHLGGKIDIVPSKPMATSYDLSLAYSPGVAEPCLEIAKDNELAYTYTNKANLVAIVSDGSAVLGLGNIGAQASKPVMEGKACLFKKFANVNAYDIEINVHSIEEIVNFCKALAPTVGGINLEDIAAPKCFEIEAALQDLGIPVMHDDQHGTAIISTAGLMNAMEISGKKFKDIKVVVSGAGAAGIASAKMYRNLGVENIILVDSKGVISKDRNDLTPQKLEFAVDSKEKTLKEVLKGADVFLGLSAPKILDDEMVLSMAKDPVIFALANPIPEVMPEDVARLRKDAIVGTGRSDYPNQINNVLGFPFIFRGALDVRASKITENMKVAAAKALADLAKLPVSDAVKKAYNLSTLEFGRDYVIPKPFDERVKAAVSTAVAAAAVKDGVAKVKNFDEKAYFESLK

SEQ ID NO: 4265 - protein, 299 aa, Salmonella typhimurium
MSRKDGFLALLVVVVWGLNFVVIKVGLHHMPPLLLAGLRFLLVAFPAIFFVARPKVPLTLLLGYGLTISFGQFAFLFCAIKFGMPAGLASLVLQAQAFFTMALGAFVFSERLQRKQLAGIALAIIGVLVLIEASLNGQHIAMSGFMLTLAAAFSWACGNIFNKKIMQHSPRPAVMSLVVWSALIPILPFLLSSLLLEGADHITQSLITIDMTTILSLLYLAFVATILGYGIWGALLGRYETWRVAPLSLLVPVVGLASAAVLLGETLTGMQLAGAVLIMAGLYINVFGFRVRRTARVSG

SEQ ID NO: 4266 - protein, 193 aa, Glycine max
MKFRYAMVCSSNQNRSMEAHFLLKRQGFDVSSYGTGAHVKLPGPSLREPNVYDFGTPYKHMIEDLRRKDPDLYKRNGIFPMLKRNSTVKLAPQRWQENAADGSFDVVVTFEEKVFDMVIEDLHNRDHALLKTVLVINLEVKDNHDEAAVGARLTLDLCREIEAAESWEESIDEIIAGFENKHRRKLLYSISFY

SEQ ID NO: 4267 - protein, 357 aa, Zea mays
MTLSKKQGAGTDQQALLDAQLQLWHHTIAFVKSMALKAAVDLRIADAIHLHGGSATLSQIVTKVTLHPSKIPCLRRLMRVLTLTGVFSVNSGAVVDEPVYGLTPASRLLVGPGLNQTPFLTLMLSTFFVSSFLGLDEWFQHETGPSPFELANGRDIWTLSGHDASFGKLFDDGMVADSGFIMDVVVKECGDVFRGVGSLVDVAGGLGGATQTIAKAFPDVACSVLDLPHVVAAAPTGTAVKYIAGDMFQSIPAADVVFLKWVLHDWGDAECVKILQNCKKAIPSEGGKVIIMDIVVGAGSSDRKHVETQVLFDLFIMAINGAERDEEEWKKIIFEAGFSSYNIIPVLGVRSIIEVYP

SEQ ID NO: 4268 - protein, 94 aa, Zea mays
LQSLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQ

SEQ ID NO: 4269 - protein, 427 aa, Bifidobacterium longum DJO10A
MLGGAAFLADSVLTPAVSISSAVEGLKTLPALEHLFTENKDLTMMITAVIIVILFAVQSRGTESIGKVFGSVVMVWFAFLAIVGVVAIGNDWSVLAALNPYYGIKFLFSPNNATGLALMGTVFLSTTGAEALYSDMGHVGRGNIYFTWPFIKVALVLNYFGQGAWMLRNQNNPELADAEGINPFFQMMDPNVRYVAVVLSVTAGIIASQALITGAFTMVSEATGLNWMPHLQVRYPARTRGQLYIPVVNVVLCVATLAVLLLFRDSEHISAAYGLALTITMITTTILLGIYLWHRSNKFGAVVFTIVFLAIQVLFFAASMAKFLHGGWFTLLLTLAILMIMYTWNEGTKLERSQRRHMMPKDFLPALDKLHGDSRIHRFADNIVYLTSDPDLKRLDTDIFFSIFAAHQARPRMVGGGRRDHRRAVHP

SEQ ID NO: 4270 - protein, 1027 aa, Oryza sativa
MATGGEPRAAAAAEGGEKRAALLREITEEGGFAFVASAEKAAADGDLRAAEAAREMAWEQLHACPRSEVGRAWRDAYALACLHVAALRVAGGGGDGRRAALRALDMGLIMGGDLLRAELEEAIARVVADRSRGCGGGGGDGAGENGADVEKWMEGLTRKRDLADVLKVLPVKSLSCKQIERRSCISLEAFIRDYFLCESPVILSGYIDHWPARTKWKDIRYLERIAGDRTVPVEIKELREDIMVPEYCNAGGGELQKLNAWFGPEGTVTPLHHDLYHNLFAQGNPQILVFIQRVDHPLCFEITGMFALHQSSYSDKRLWPYPKWLHVLGRKYFRLYSASISNDLYPHRETMLSNISQVDLDNINVNEFPRTGDVEFMDGILEEGLRVRYTLYPSIYVAYRYGIPTRIRIFSAHIKEILHGIYGWKEFYSDKAGSSMYRVRSCTNVPQYPLYPVYGYHPSTVARQVGALGAQGSTTMSSSFVDNSVNTNLNQVFPASTMLVWTQVDEIVFPVYTTIPISAGPSMTGNKNAVATDQDDSLSKDPPAEAENGTSTTSELEKDSNAAKPCCPDMNREPMKMTSEATKSWCPIHKTRKHTLQACWVFLNVRAEIRACKERGIQRISPTRDVYYPIHKTKNHDLSSCKVFLSAMKAPSPKVQQSHIPIRDKDKEQGAMPTSDRFVGVIDIDPHEPSVLHLLVDYGSSRTSAPREVLAIDDVGTSARTNAEAENQLATPAQHIRAVNAILRKTPYDPVLNDDLARWTERLRESVTNLSNAFGEAAAAAHPEQPPTGDANGEDPERRESPHRATPPPGGTGDLRDHLNGRREARRTRDNENRSRRHVSSRRHDNEDRGDRSNEDRDYDNRHHRHDHNDRERRVPGDTSRGRRHNDDDDGDRRRDNSGRQRQDSRDPGRHPRNRTPEPSDPSSSSSSSSSSSSDRHPRRTHDRRQPTVPSARCRAFSRSLRDVRWPERFRLGAIEKYDGSTDPEEFLQVYSTVLYAAGADDNALANYLPTTLKGSARSWLMHLPPY

SEQ ID NO: 4271 - protein, 477 aa, Mesorhizobium loti
MSEARSYELFINGKWRAGGSRVTLPVINPATEKVVASVASATVSDLDEALASAERSRKAWCSRPAKERGEILVAAARVLATQIEPAARDLSAEQGKTIAEATGEYARAVETLEWNGTHAEELSATIPLGPNRMIVPEPLGVVAAFTPWNYPAVLITRKLAPALAAGCPVILKGAEETPSVAVHIVESLRQAGVPDGVVNLVFGVPVHISRHLLSSPIVKVLTFTGSTAVGKQLAMLAANNLQRCILELGGHSPVIVCEDADLAKAIPAISEYKFECAGQSCNAPSRILVARTLYEEFLSRMTEAARKIRIGLPDDPATEMGPMANARRIEAMQRLTKDAVDRGAHIETGGTRLDGAGFYWPPTILTGVPKDARVLHEEPFGPILTVAPFDTLDEAIGEANDTEYGLAAYFFTDAADTQRKLTNSLSAGAVSVNYLKGVSADAPYGGVKQSGYGYEGGEQGVRSFQILKMVNGLGSFG

SEQ ID NO: 4272 - protein, 298 aa, Neisseria meningitidis
MPSENPSQRKKEKMKGIILAGGSGTRLYPITRGVSKQLLPVYDKPMIYYPLSVLMLAGIRDILVITAPEDNASFKRLLGDGSDFGISISYAVQPSPDGLAQAFIIGEEFIGNDNVCLVLGDNIFYGQSFTQTLKQAAAQTHGATVFAYQVKNPERFGVVEFNENFRAVSIEEKPQRPKSDWAVTGLYFTTTAPSISPNSSNRPHAANWKFPTSTGCIWKTARSPFKYWDAVSRGWTPVRTKACTRRLRSSKPCKTSKTCTSPAWKKSLGATVGFPMKNWKNWRARWRKTNTANICCAC

SEQ ID NO: 4273 - protein, 116 aa, Actinobacillus pleuropneumoniae serovar 1 str. 4074
MEIPAGETAKIVKMVEKPSVEEAPSNLAVVGRYVFSAGIWDLLEKTPVGVGDEIQLTDAIDMLIEQETVEAFHMTGRTFDCGDKLGYMQAFTEYSLRHDKFGNDFKEFIKKLAKTL

SEQ ID NO: 4274 - protein, 325 aa, Zea mays
MDMISGSTAATSTPHNNQQAVMLSSPIIKEEARDPKQTRAMPQIGGSGERKPRPQLPEALKCPRCDSNNTKFCYYNNYSMSQPRYFCKACRRYWTHGGTLRNVPIGGGCRKNKHASRFVLGSHTSSSSSATYAPLSPSTNASSSNMSINKHMMMVPNMTMPTPTTMGLFPNVLPTLMPTGGGGGFDFTMDNQHRSLSFTPMSLPSQGPVPMLAAGGSEATPSFLEMLRGGIFHGSSSYNTSLTMSGGNNGMDKPFSLPSYGAMCTNGLSGSTTNDARQLVGPQQDNKAIMKSSNNNNGVSLLNLYWNKHNNNNNNNNNNNNNKGQ

SEQ ID NO: 4275 - protein, 370 aa, Zea mays
  unsure (1)..(370): unsure at all Xaa locations
MHTMALSTQDLLEAHVELWHQSLCYAKSLALAVALDLHIPDAIHHHGGSATLPQILAETAAHPSKLRALRRLMRVLTVSGTFSVEQQPPAGGDDSTVDAPDEAVYRLTAASRFLVSDEVSSSTLAPFVSLALHPIAVSPHTMGICAWFRQEQREPSRMAWLFNKHSQXIWEHADDVNALLNKGMVADSRFLMPIMLRECGEMFRGINSLVDVGGGHGGAAAAIAAAFPHVKSSVLDLPHVVASAPSDGNVQFVAGNMFESIPPATAVFLKKTLHDWGDDECVKILKNCKQAIPPRDAGGKVIILDVVVGYKQSNIKHQETQVMFDLYMMAVNGVERDEQEWKKIFFEAGFKDYKILPVIGDVSVIIEVYP

SEQ ID NO: 4276 - protein, 421 aa, Burkholderia fungorum
MDTPARLNDLQRTTLAIVLAGGRGTRLGPLTNKRVKPAVHFGGKYRIIDFALSNCLNSGIRRIAVVTQYKAHSLLRHLQRGWSFLRGEFGEFIDLWPAQQRVEGAHWYRGTADAVFQNLDIIRSIRPKYVVVLAGDHIYKMDYTRMIADHAESGADCTVGCIEVPRMDAVAFGVMHVDENRRVTGFVEKPADPPAIPGRPDTALASMGIYVFSADYLYSLLEENISSVDTDHDFGKDILPRVVTQGTAIAHPFSMSCVSSDPNVEPYWRDVGTIDAYWAANLDLASTIPTLDLYDRSWPIWTYQEQLPPAKFVRDMKGLQGSGNNLIVCGGCVISGSQISRSVLSSNVKVSSFCNINEAVLLPQVTVGASCRLQKVVIDRGCAIPDGTVIGEDPVSDAERFYRTDDGVVLVTPEALRQMPK

SEQ ID NO: 4277 - protein, 583 aa, Bromus tectorum
LRPWGPSEPRKGADILVEALERCGIVDVFAYPGGASMEIHQALTRSPVITNHLFRHEQVEAFAASGYARASGRVGVCVATSGPGATNLVSALADALLDSIPMVAITGQVSRRMIGTDAFQETPIVEVTRSITKHNYLVLDVEDIPRVIQEAFFLASSGRPGPVLVDIPKDIQQQMAVPAWDTPMSLPGYIARLPKPPSTESLEQVLRLVGEAKRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQKSLDFGPWQEELEQQKRTFPLGYKTFGEAIPPQYAIQVLDELTKGEAIIATGVGQHQMWAAQYYSYKRPRQWLSSAGLGAMGFGLPAAAGASVANPGVTVVDIDGDGSFLMNIQELALIRIENLPVKVMILNNQHLGMVVQWEDRFYKANRAHTYLGNPENESEIYPDFVTIAKGFNVPAVRVTKKSEVRAAIQKMLDTPGPYLLDIIVPHQEHVLPMIPSGGAFKDIIMEGDGRIEY

SEQ ID NO: 4278 - protein, 572 aa, Schizosaccharomyces pombe
MAFGSKILNIGSKSDEYNDDAVPLDQVEEGAQERRYYLGLTKREFKLMMLAGVGFFLDSYDLFIINLVTPIFEYLYWGGIEKGPTGKGHYPSGIRGLVNASANIGNIFGQLLFGFMGDFFGRKFVYGKEMVIVIIATVLVIAMPKSIHSPLSKMMWVFCWRWLLGVGIGGDYPMSAAITSERSKIKRRGTLISLIFAFQGFGTLAGAIVTIILLGCFEHPLNREGHYHKLEGVWRLQFGLALVPAIGVLIPRLIMKESKSYENSKALNSAEGKDPKAFFNTDDEDNMKKSSSHGDSEVVEASDRYANQADAADAEVDNIEKQFAAVTTPENSSGFITYFRQWRHFKHLLGTSVCWFLLDIAFYGVNLNQSVILKNIGFSTGTNEYRTLMKNAIGNLIIAVAGYVPGYWFNVFLVEILGRKWIQLQGFVITGLMFAILAGRWNEISTGGRFACFVIAQLFSNFGPNSTTFIYPAEVFPARVRGTAHGVSAALGKCGAILASLLFNFLTGVIGYGNVMWIFCGCMWGGILFTLLLPETKGRDADEIDRLELFYGKDGKVQCDSKWKSWYFNGIF

SEQ ID NO: 4279 - protein, 161 aa, Zea mays
MEALKYWMEQDRVLELFCRLLIAVYGILWGFSASGPGADPKVDYACTPEEVQQHFQACGTVNRVTILTDKFGQPKGFAYVEFLEQEGVQEALNLNESELHGRQIKVAPKRTNVPGMKQRPPRGYNPYHGYPYRSYGAPYFPPYGYGRAPRFRRPMRYRPYF

SEQ ID NO: 4280 - protein, 475 aa, Streptococcus agalactiae
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVLDMK

SEQ ID NO: 4281 - protein, 210 aa, Triticum aestivum
  unsure (1)..(210): unsure at all Xaa locations
MNYVALTMLEEGXDSCEAMLQARSWXILDHGGATITPLWGEYFLSVLGAYDWPGNNPLPPELWMMPYFLXMHPGRMWSNCRLAYLPMSYLYWKRLVGATTSNVLDLRKELYNVPYNEINXDKACNGCAKEDLYYPHSPIQNIVWATLKKMGEPDIMHWPESNXEQKLWTYDMKHIKGEDETTHYICIATVNKMLNMICCWXEQPMSEAFK

SEQ ID NO: 4282 - protein, 368 aa, Medicago sativa subsp. X varia
MRPIQLPPPTATGSATASGSPNNNNNSRPQRRRKDHLTLPLPQRDTNLAVPLPLPPSGGSGGSGGGGNGSGSGGASQQLVIPFSELERLNRIGSGSGGTVYKVVHKINGRAYALKVIYGHHEESVRRQIHREIQILRDVDDVNVVKCHEMYDHNAEIQVLLEYMDGGSLEGKHIPQENQLADVARQILRGLAYLHRRHIVHRDIKPSNLLINSRKQVKIADFGVGRILNQTMDPCNSSVGTIAYMSPERINTDINDGQYDAYAGDIWSLGVSILEFYMGRFPFAVGRQGDWASLMCAICMSQPPEAPTTASPEFRDFVSRCLQRDPSRRWTASRLLSHPFLVRNGSNHNQSPPNMHQLLPPPPRSLSS

SEQ ID NO: 4283 - protein, 415 aa, Zea mays
MMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRNGRKEKGVTALDPRANNFDLMYEQVKAIKQGQAVQKPIYNHVTGLLDPPELIAPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSTISWVPCGRKLTCSYPGIKFSYGPDTYFGNEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 4284 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYELMLRQHVDAGADVTVGCLEVPRMEATGFGVMHVDAKDNIIAFVEKPADPPGIPGNPEFALASMGIYVFKTKFLMEQLRRDAADPGSSRDFGKDIIPYIVQHGKAIAHRFTKSCVRSTMENEAYWRDVGTVDAYWEANIDLTDVTPELDLYDRDWPIWTYAELKPPAKFVHDEDGRRGSAVSSLVSGDCIVSGASLKKSLIFTGARINSYSALEEVVMLPDVHVGRNAKLKRVVIDHGVRIPEGLVVGEDPVLDAKRFRVSEKGICLVTQDMINKLGL

SEQ ID NO: 4285 - protein, 297 aa, Ralstonia metallidurans
MQAKDRLLALAIIVVWGVNFVVIKVGLVGVPPMLLGALRFCLVAFPAVFFIPRPRIPLRMLVAYGATISLGQFVFLFYAMAVGMPAGLASLVLQSQVFFTVAIAGFWLGEPVRWHNIAGMAIAACGLALIGSGAAHGPGGMTLAGFLLTLCAALCWATGNIVSKKIGPVDLLGLVVWGALIPIVPFALLSLWFEGPARMTQALTNISGMGVFAVCYLAFCATLFGYTMWGRLLTRYAASKVAPLTLLVPVVGLVSAHLLLGEALALTQWAGALVVMAGLLLNVFGGRLWAGRMLAGR

SEQ ID NO: 4286 - protein, 105 aa, Glycine max
MDIRLMDLDSPLFNTLHRIMDLTEDDNVLLISGERKREEDKEKEGAKYLRMERRVGKFMRKFTLPENANTDAISAVCQDGVLTVTVNKLPPPQPKKPKTIKVKIA

SEQ ID NO: 4287 - protein, 474 aa, Gracilaria tikvahiae
RYESGVIPYAKMGYWDPNYVVKDTDVLALFRVSPQPGVDPIEASAAVAGESSTATWTVVWTDLLTACDLYRAKAYKVNEVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRSIAATGEVKGHYMNVTAATMEDMYERAKFAKQLGTVIIMIDLVIGYTAIQTMAIWARRNDMILHLHRAGNSTYSRQKIHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILLDAAKTCGPLQTALDLWKDITFNYTSTDTADFVETPTANV

SEQ ID NO: 4288 - protein, 506 aa, Pseudomonas aeruginosa
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAESIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 4289 - protein, 278 aa, Glycine max
FFFIQARSLSLRSIQTLFLFFTIPILWRRFALEVLGKNGCLVEGVLHLPGNPPVKLDSQDLLQIGDKEFYFLLPVRSILVGPVGPRHYPNHAAPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTLEFVSLVSLIS

SEQ ID NO: 4290 - protein, 242 aa, Oryza sativa
MVLIIIGTLNNRARSSNRVSTVRSNGFWRSRCRDNVHMRHIPPCAPVPARYTVPTPPRSQRPRNRSREISHIRGARSAPGSSVVGPYIPPRARPTSYQPSTTNTHPAVPLPPWQVDVSLLDVPLLLLHALTVRTSGGHRPAPYGDHGVQEAGAAQADAAEGAGGDDDGLPGDVPRGHFAVYVGISRRRYIVPVACLAAPEFQELLRKAEEEFGFDHDMGITLPCDEATFHGVLASASATSIR

SEQ ID NO: 4291 - protein, 295 aa, Glycine max
DSYTFGFGWCIPKVAFLASAVGPRVAASCAHAALAVLSEDNSGSTSQMEAPGHDNRTNSENIHCRDGGPHGETAVSNNHNEDKAKVRGSWGLNEGRITPLSAEKVKDAAKAGLSAAAMKAKLFADHEEREIQRLCANIVNHQLKRLELKLKQFAEIETLLMKECEQLERTKQRCAADRSRIMSARLGTVGATPTMNASGVGPSMASNGNNRQQMISASSSQPSVSGYGNNQPVHPHMSFAPRPSMFGLGQRLPLSMIQQSQPASSTAMFNAPSNVQPTTNHPLLRSVSGTNSGLG

SEQ ID NO: 4292 - protein, 468 aa, Saccorhiza polyschides
IPYAKMGYWDADYNVKDTDILAIFRITPQPGDEPVEAAAVVAGESSTATWTVVWTDLLTACDIYRAKAYRVDPVPGTNDQYFAYIAYECDLFEEGSLANLTASIIGNVFGFKAVAALRLEDMRIPYAYLKTFQGPATGVVVERERLDKFGRPLLGATVKPKLGLSGKNYGRIVYEGLTGGLDFLKDDENINSQPFMRWKERFLYCMEGVNRSAAATGEVKGSYLNVTAATIEQMYERAEYAHAIGSVICMIDLVVGYTAIQTMAIWARKAEMILHLHRAGNSTYARQKNHGINFRVICKWMRMCGVDHIHAGTVVGKLEGDPLMVKVFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFEYTSTDTPYFVEVATQSN

SEQ ID NO: 4293 - protein, 287 aa, Archaeoglobus fulgidus DSM 4304
MGLLQDYSQRREEGEGRGSNFTRFSCWSCDFCRCLCNAEIAGESGGKVCCCGGKGGGPDQHSETRSCDNSGSWGRYGLAAFAPCSSLRLPAYLHLHEIQKIVIIFYATKIMGRHLTVFIIALAAVFAACAEEKEMAKSLTVKSAFENGGKIPAKYTCDGEDISPPLYIEGLREDVKSLVIICEDPDAPMGVFTHWIAWNVEPTSEIPENVPKTKFVDEPKMVQGRNDFGKVGYNGPCPPSGEHRYYFRIYAIDTLLQGDYSRQELLRAIEGHILQYGEIYGLYSRSR

SEQ ID NO: 4294 - protein, 394 aa, Zea mays subsp. mays
LGAERRARLPPGEMWWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 4295 - protein, 202 aa, Neurospora crassa
MSDSPQSNSKDVEQGAPSPGEEPQMNDPQDPHSSGLNQYEFEVKEQDRWLPIANVARIMKNALPENAKIAKEAKECMQECVSEFISFITSEASEKCQQEKRKTVNGEDILFAMTSLGFENYAEALKIYLSKYREQQNQTNRSENQQNRPSSQGYGAPQGQNQPGQGGFSSNDLGGQQESGDASGYNLYGAQTGHNGGGAEGY

SEQ ID NO: 4296 - protein, 159 aa, Frankia sp. FE56
ITKEQYSRDPRNIAKKAEAYLRGTGIADTAYFGPEAEFYIFDDVRYDYNPYGSMHAVDSVEAAWNTARKEEGGNLGYKPRFKGGYFPVPTTDHFTDLRSEMTRVLFEVGITVEMQHHEVGTAGQAEIDIRYDTLLKTADNLMLYKYVIRNVARSRGKTV

SEQ ID NO: 4297 - protein, 193 aa, Zea mays
PISAAPAVGPVSDKQASAPKGNSAELQKKTIALLEEYFGIRILDEAHQCIVELQSPDYYPEIVKEAVNLALDKGTNFVDPLVRLLEHLYTKKIFKTQDLESGFLLYGTLLDDIGIDLSKAPAQFGEIIARLTLLGALRFEALEVILKKMEDTYNPKAVSNAFMKTLEANPSGQAILGSPAAAAVIDACNSLLE

SEQ ID NO: 4298 - protein, 497 aa, Spinacia oleracea
MAFPIPARQLFIDGEWREPIKKNRIPVINPSTEEVIGDIPAATAEDVEVAVVAARRAFRRNNWSATSGAHRATYLRAIAAKITEKKDHFVKLETIDSGKPFDEAVLDIDDVASRFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 4299 - protein, 1806 aa, Streptomyces avermitilis MA-4680
MDLIPRGSAPRTRRTHRHSRTAAAVAAAALAVSLAQPLEARAATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 4300 - protein, 333 aa, Saccharomyces cerevisiae
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSFINDEPHFRYVLNEDQMATEKLSDGIRKFSADIEALYKLVEEKM

SEQ ID NO: 4301 - protein, 405 aa, Glycine max
  unsure (1)..(405): unsure at all Xaa locations
MPEETTSIDYVMEAASGPHFSGLRLDGRMPSSATAAAASSSADSTLTPDFLPNQPFVIGVSGGTASGKTTVCDMIIQQLHDHRVVLVNQDSFYRGLNPEELERVHEYNFDHPDAFDTEQLLECTMKLISGQGVHVPIYDFKKHQRSSDSFRQVXTKQCRFVTTYWDFFLVDVVLLVQVNASDVIILEGILVFHDQRVRDLMNMKIFVDTDADVRLARRIRRDTMERGRDINSVLEQYAKFVKPAFDDFVLPSKKYADVIIPRGGDNHVAIDLIVQHIRTKLGQHDLCKIYPNAYVIQSTFQIRGMHTLIRDRDISKHDFVFYSDRLIRLVVEHGLGHLPFTEKQVVTPTGNHPPLSSVLAIFMFFITPLVWGTRFMLCELQHVWERSDRSTVGHKWRFMLTVLIN

SEQ ID NO: 4302 - protein, 126 aa, Zea mays
  unsure (1)..(126): unsure at all Xaa locations
MGWSGXKCVIEVXNGXXXXXXILFFFEXXEKRWGGGXFLFXMXXXXRGGGGXKIVEKYXXXKIEIYILNEXEYGGIVXEEXLXXXXXGKCGKDXWYXFGXGDVFXFLNNRGKFEILLGEGGEYVFV

SEQ ID NO: 4303 - protein, 637 aa, Oryza sativa (japonica cultivar-group)
MRSMMRLMICCLLVSAGAGGIAGEGNLDVALLLQCVKPALRREGGNTQLATWTASTPLCLWRGLRSTIQMALSRSVEVAVPADPAGDGDRDKIRLRQLGYKQELKRGLSVLSNFAFSFSIISVMAGVTTTYSTGLRYGGPVSMTLGWLVVSAFNGCMALSMAEICSAYPTSGGLYYWSAKLAGNDWAPFASWITGWFNITGQVGTFGFLGPGFSLIDGPFYWAMSTERNKFTLGPFICCPVRFSSLNHKTGVDFALAQLVQVIVLLSTGGANGGGYMASNYVVLAIYGAMLVIHGAINSLPIQCLSWFGQLGAFWNAAGVFVLVALIPAVATERASVEFIFTHFNTENGMGIRDKAYILLIGLLMSQYAMAGYDTSAHMTEETKNADWSGPIGIVTSVALSTVFGWIYIVSLTSAVTDIPYLLSPDNDAGGNAVAQAFYTTFHRRYGSGLGGILCLGVVAVAVFLCGLACITSNSRMAYAFSRDGAMPFSKVWHRVNKQEVPINAVWLSVVVAFIMALTSLGSQVAFQAMVSIATIGLCISYALPIFFRVTTARGSFVPGPFHLGKYGIVVGWAAVLWVAAVTVLFSLPVAYPVAEETFNYTPVAVGGVLLLTVGAWALRARFWFQGPITNTNDGPL

SEQ ID NO: 4304 - protein, 134 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 4305 - protein, 101 aa, Zea mays
  unsure (1)..(101): unsure at all Xaa locations
GPGASGKPYSGGYMGSLVGDFPRPFFLGGVSGSPRAKKSKKGKLGFFXGGAPMSFFVEQAGGKGFSGPQRIFAFPPPGIPQRGPLSFGGVGEVAKGEKFRA

SEQ ID NO: 4306 - protein, 508 aa, Oryza sativa
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 4307 - protein, 128 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4308 - protein, 387 aa, Zea mays
  unsure (1)..(387): unsure at all Xaa locations
MAPTTATKDDSGYGDERRRELQAFDDTKLGVKGLVDSGVKSIPSIFHHPPGSXLADIISPAPPLPPSPPSGAAIPVVDLSVTRREDLVEQVRHAAGTVGXFWLVNHGVPEELMGGMLRGVXRQFNEGXPAGEAKQALYSRDLARNLRFASNFDLFKAAGGXDGRDTLFCEVAPNPAARGEELXPEPLRNVMLEYGAAVTKLXARFVFELLSESLGMPSDHLYEMECMQNLNVVCQYYPPCPXEPHRTVGVKRHTDPGFFTILLQDGMGGLQVRLGNNGXQSGGCWVDIAXPRPGALMVNIGDLLQLVTNDRFRSVEHRXVPANKSSDTARVSVASFFNTDVRRSERLYGPIPDPSKPPLYRSVRARDFIAKFNTIGLDGRALDHFRL

SEQ ID NO: 4309 - protein, 484 aa, Lactobacillus plantarum
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAALSPDSVRGETRAQPYRYQVDYTTQAGDLYRLMSEPEQERLINTIKDALGQVTLPGVKELEIKQFYEADKNYGTRVANALGMNIADIISD

SEQ ID NO: 4310 - protein, 356 aa, Candidatus Blochmannia floridanus
MNFNYLIKNNILNLKPYQSARRLKHSGKIWLNANEYPIAPYYKGQYKNINRYPECQPPELINNYAAYSGVQSDHILVSRGADESIELLMKVFCRPNKDFIIFCPPTYGMYKTNAEILEIYYRMIPTKKNWQLDLSSIQSQLNNVKLIYICNPNNPTGNIIYLHSLKKLLKIIQNKALLVCDEAYIDFCRHASLIQLLTEYPNLIILRTLSKAFALAGLRCGFTLANPKIINLLTKVITPYPIPTPVIDIATQALTPQNIQYTQTRIKKIHNNRNMLIKALKQCSCVQQIFPSYTNYILVKFYPQYQVFKTLLNQGIVLRDQSYQPGLMHCLRITIGSYNECQLVISTLKKLKHSTF

SEQ ID NO: 4311 - protein, 424 aa, Zea mays
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDA

SEQ ID NO: 4312 - protein, 98 aa, Trichodesmium erythraeum IMS101
  unsure (1)..(98): unsure at all Xaa locations
MAEIRELKPDGVVISPGPGRPEDAGISQALIQELGATLPILGVCLGHQSIGQVFGGKITPAAELMHGKTSEVYHNXXXXXXXXXXXXXXXXXXNYYGC

SEQ ID NO: 4313 - protein, 178 aa, Lactobacillus brevis
NPVVYDPTVADSIEQYSHLFTDPQNAAFISVDAPEDIEATLKNAAGDRDIRLVVVTDPKNFGYGPTGVLTGLDIAVGKLMVYTAAAGMIQHKSCQLALMAGTNNQTLLNDRYYLGNHHERVYGDKYHAVIDQFVAAEQKLFPESLLHWEDFGRSNAQVILDKYKDKIATFNDDIQGTG

SEQ ID NO: 4314 - protein, 353 aa, Neurospora crassa
MSKAADIPKEQWAQVTEKDGVITYKKIPVPTPGHDEVLVNIKYSGVCHTDLHALDNDWPLPRKTPVIGGHEGAGVVVQKGELVTNVDIGDKVGVKWLMSTCFHCTFCQQALESLCPKAQLSGYTKDGTFQQYCVANAAHLARFPPQTDLSAVAPIMCAGLTVYKGLKESDTRPGQYVAIVGAGGGLGTIGIQYAHAMGLNVIAIDGGKEKGEACKKLGASMYIDFKESKDLVADVKKATHDGLGPQGVVLLAPQEQPFQQATGYVRSHGTVVCIGMPAGAKVSMPVFDTVVRMIKVKGSYVGNREDTAEALDFFLRGKVHAPYKVIGLSQLQSVFDEMRANRVIGRYVMDMSK

SEQ ID NO: 4315 - protein, 893 aa, Novosphingobium aromaticivorans
MPTLVWRIQPRTRAIPARSRLAECAGAVIPMYLGVRCEPAQPLPQAPQGACRKKQAGGDEGPVQQGPARAWHVHRPFRTRQGGTTGMSLDKNSRAAEIDAQIIDVLRHRVGKDERAAKPHDWYTATVLTLRDAIIDRWMESTRKTYAESGKRVYYLSLEFLIGRLLRDALSNMGLTRDMELALREHGFDLSALEDLEPDAALGNGGLGRLAACFMESLASLDIPAYGYGIRYVNGMFRQRIDDGWQVELPETWLSHGNPWEFDRRESAYIIGFGGEVVEKADGVEWRPAEKVEASAVDTPVVGWRGKRVNTLRLWTAHAFDPLRLDAFNAGDHFGALAEQVRADSLVRVLYPADSTPAGQELRLRQEYFFTSASIQDIVRRHVQYNGDIRTLPEKAAIQLNDTHPAVAVAELMRLMVDVHGLEFNEAWEVTKATVGYTNHTLLPEALESWPLPLFERLLPRHMQIVYAINSRVLREARKAGLDDAAISAISLIDEGGERRVRMANLAFSGAHSVNGVAALHTELMKTTVFSDLHKLYPARINNKTNGVTPRRWLQQCNPGLTSVLKDAIGDCFLDDAEKLSDLNALADDPALGERIAEVKRTNKIALAKHVKELMGIRLDPDALFDVQIKRIHEYKRQLLNLIETVALYDQIRSHPERDWVPRVKIFGGKAASSYHNAKLIIKLANDIARRVNSDPSVGGLLKVVFVPNYNVSLAEKIIPAADLSEQISTAGMEASGTGNMKFALNGALTIGTLDGANIEIKDRVGDANIEIFGLTAQEVEDKRANGYNPREVIESSRELQQAIAAIATGVFSPDDPQRYAGLMGGIYDHDWFMVAADFDAYHAAQRNIDRRWEQQPSWRASAIRNIANVGWFSSDRTIGEYARDIWGVRDRA

SEQ ID NO: 4316 - protein, 509 aa, Zea mays
MVKAVVVGAAVVACAAVGVAVVLERRRRKRDADLLGSAEAERRRRAAAVIEEVESSLATPTALLRSIADAMVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPVNQTSISSGTLIKWTKGFSINGTVGEDVVSELSRAMERQGLDMKATALVNDTVGTLAGGRYMDTDVVAAVILGTGTNAAYVEHANAIPKWTGLLPKSGKMVINTEWGSFKSNKLPLSEYDKAMDFESLNPGEQIYEKMISGMYLGEIVRRILLKLAHEASLFGDVVPPKLELPFILRTPDMSAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 4317 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTSMSVEPAKSANSKEKNSNKKLKEIDRTAVSAGSGNSKRTVSSIEDYSAEASSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSSATDVAAVS

SEQ ID NO: 4318 - protein, 320 aa, Clostridium tetani E88
MDYYMALVTTKEMFSKAYEGKYSIGAFNINNMEIIQAVVNAAKKENSAVILQVSASALKYAGPKYLKHMVDAAIEDTGIDIALHLDHGANLDQVKLAIETGFTSVMFDGSHYDYDENVRLTKEVVEYAHNRGVVVEAELGQLAGVEDDVKVSGKDATYTDPDQAADFVEKTGVDSLAIAIGTSHGAYKFKGEAKLDFERLEKIQENLEKKGFKNFPIVLHGASSVDPHFVAICNEYGGEIGGAKGVPNEMLRKASSMAVCKINMDTDLRLAMTATTRKFLSENPKEIDPRKYLGAAREAIEGLVQNKIKNVLGSSNSLNK

SEQ ID NO: 4319 - protein, 477 aa, Ahnfeltiopsis vermicularis
KNERYESGVIPYAKMGYWDPDYVVKETDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIICERERMDRFGRPFLGATVKPKLGLSGKNYGRVVYEGLRGGLDFLKDDENINSQPFMRWKERYLYSMEGVNRSIAASGEIKGHYLNVTAATMKIMYERAEFAKELGSIIIMIDLVIGYTAIQTMAVWARKNDMILHLHRAGNSTYSRQKIHGMNFRVICKWMRMAGVDHIHAGTVVGKLEGDPLMIKGFYNTLLLPYLEVNLPQGIFFEQDWASLRKGTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 4320 - protein, 529 aa, Glycine max
  unsure (1)..(529): unsure at all Xaa locations
SEVTAMASACVTLKSNTHLANSEKGFLGERIKGGFNNSALVMNQLAIRSRSHKRVKHGVGVVSAVLTSNNAKESLTLQVPSFLRRRADPKNVISIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFEDAKHTNVENVLILAGDHLYRMDYMDLVQSHVDRNADITVSCAAVGDSRASDYGLVKVDDRGRIIQFSEKPNGADLKAMQVDTSVLGLPPHEAKRSPYIASMGVYVFKTDVLLKLLKWRYPTSNDFGSEIIPAAVRENNVQAYFFXDYWEDIGTIKSFYDANLALTEENPMFKFYDPKTPIYTSPRFLPPTKIDKCRIVDAIISHGCFLRECTVQHSIVGERSRLDYGVELQDTVMTMGADYYQTEXEIASLLAEGKVPIGIGRNTKIRNCIIDKNAKIGKDVIIANKDLSLXGVQEADRPEDGFYIRSGITIIMEKATIEDGTIV

SEQ ID NO: 4321 - protein, 113 aa, Zea luxurians
  unsure (1)..(113): unsure at all Xaa locations
MGRRACCAKEGVKRGAWTTKEDDALAAYVKAHGEGKWREVPXKAGLRRCGKSCRLRWLNYLRPNIRRGNISYDEEDLIIRLHKLLGNRWSLIAGRLPGRTDNEIKNYWNSTLV

SEQ ID NO: 4322 - protein, 240 aa, Ceratopteris richardii
MQETYCNVLQKYHDELMQPYKEAMTFFRKIELQLNALSKGTVRLCHTGDDKADANCNSGQHGLISGGSSGEEDAEEGDVSCGEVDFHEEMIDPLADDQKVKEQLLRKYSGYIYKLKQEFLKKKKKGKLPKNAREKLLDWWNQHYKWPYPSEAEKAALAETTGLDQKQINNWFINQRKRHWKPSEDMQYVMVDSPTAHHHHHVLHGHAHLTPHPLAPYAVMETMDAAAAAAAAVTMLPSLQ

SEQ ID NO: 4323 - protein, 428 aa, Nitrosomonas europaea ATCC 19718 [sequence omitted]

SEQ ID NO: 4324 - protein, 427 aa, Batrachospermum kraftii
IEASAAVAGESSTATWTVVWTDLLTACDLYRAKAYKVDAVPNTSDQYFAYISYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAGTMEDMYERAAFAKELGSIICMIDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESIVIARNEGRDYVNEGPQILKDAAKTCGPLQTALDLWKDISFNYTSTDTADFV

SEQ ID NO: 4325 - protein, 255 aa, Buchnera aphidicola str. APS (Acyrthosiphon pisum)
MKKFFITANWKLNGNIKMISSFFKYLKLYSSSYLEKNTVIIAPPTIYLERVCKNISNMNIFLGSQNVDINLNGAFTGETSILMLRDIGVKYVIIGHSERRFLHHETDDIIAKKFHLIKKSNLTPILCVGETEIEKKHNQTEQVIQRQLNLILKNLGTSAFKNIIIAYEPIWAIGTGVSADPEHVQLIHVFIKNYILKYSSINRNDIIIQYGGSINHTNVKKFIEQPDINGLLIGNSSLSAKEFLEIIKIAHEHYS

SEQ ID NO: 4326 - protein, 276 aa, Auxenochlorella protothecoides
CFAYSFSSILVEIQDTLRQPPKAAKTMSKATNVSVTASFAFYFVVAIGGYASLGNDVPSYILGGLQGPEWVIFVANLCVLLHMWSAYQIYAHPMFDTLESHVKAFKLRQAKAKGDAELPAKVEELKRMSLAARQGSAAGTKTMDDTAPAAPPAANPLCRLSRVSAMAGEKLQRLSQNAAMYRVSTGFADTSVPSNDDHFVLPWWQRLITRRMYVVRTTLIAAIMPFFGAMAGLVGALAFFPLTSSSPSAAGAPCTSPLGGSITCCTSSSSAWRWCA

SEQ ID NO: 4327 - protein, 429 aa, Thermoanaerobacter tengcongensis [sequence omitted]

SEQ ID NO: 4328 - protein, 371 aa, Oryza sativa (japonica cultivar-group)
MVRSTCCVVLLLLLSVAARSASAIMDGLLPNGNFEEAPDKSQLNGTRVIGRYAIPQWEISGFVEYIGSGQMQGDMLLPVPEGAYAVRLGNEASIQQRLTLTRGMHYSVTFSAARTCAQSELLNITVTPEIGEVPIQTVYTSSGWDSYSWAFKARRSDVSLIVHNPGVTDDAACGPLIDSFAIKTLQSPPSTKDNLLKNGGFEEGPYIFPNTSWGVLVPPMDEDDYSPLSPWTIMGYTKSVKYVDAAHYAVPGGARAVELVAGMEAALVQEVCTVPGRSYRLEFSVGDAGDGCVGSMSVQAYVSHGSVKVPYESQGRGGYKRGVLEFTATDKRTRVVFVSMAYTMKPDGTLCGPVVDDASVVGVHSHRRLLL

SEQ ID NO: 4329 - protein, 367 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 4330 - protein, 278 aa, Lactobacillus plantarum WCFS1
MQSKLAVIIGGTSGVGKHTAIDLANQNYHVIIVGSRADKGRQAQADISQATGNQAVQLALADLSTKTGVQQFAHQLAAMTDHIDILLNSIGVILPERHLSADGYDLNLVLNYLTHFWTIQALLPLLKHSDQARILLVGALPFVINHAKVSLPDFDAPATSKYNAMTVTAQATAARVLLTLALSERLTATNVTINIFHPGYVPDSNFGAGGSWVSRLAGRILGESFSRKNSPIGAWLATAPELTHTSGHFYDDRLRQVRLSKQYTRSKANDLWRLSSQY

SEQ ID NO: 4331 - protein, 332 aa, Campylobacter jejuni subsp. jejuni NCTC 11168
MAVKVAINGFGRIGRCVARIILERNDIELVAINDTTDIELTKYLFKYDTVHGEFKGSVDSEGDDLVVNGKKIKVFKSRNVKDLDFAKHGAQIVLECTGAHLTMAKCQEFIDMGVQKVIMSAPAKDDTPTYVLGVNSELYKGESIISNASCTTNCLGPVCRVLQDNFGIEKGLMTTIHAYTNGQSIIDAKAKDKRRSRAAAQNIIPTSTGAAKAMKLVMPELNGKLHGQSMRVPVIDVSSVDLTAQLSRKVSKDEINEAFRKAAATNLKGILMVDDDERVSSDFITCSYGAIVASDLTQVIADDFIKVIAWYDNEWGYSSRLVDMAVYIANKA

SEQ ID NO: 4332 - protein, 116 aa, Triticum aestivum
PTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNC

SEQ ID NO: 4333 - protein, 187 aa, Glyptostrobus lineatus
ICTYFAQPLHQRDYTRWPEKPEGWREIVDKYSEALMGLASKLLAIISEALGLEPEAVTKACVEMDQKVVINYYPKCPQPDMTLGLKRHTDPGTITLLLQDQVGGLQATKDDGLNWITVEPVQGAFVVNLGDHMHYLSNGKFKTADHQAVVNSNYSRLSIATFQNPSQEAIVYPLKLEEGEQSFMEEP

SEQ ID NO: 4334 - protein, 237 aa, Pinus taeda
MGSLETEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHMGVKIAKAFGLHVTVISSSDKKKEEAMEVLGADAYLVSKDTEK

SEQ ID NO: 4335 - protein, 508 aa, Vicia faba
MSSIVTSGVINVPRSSSSSKNLSFSSSSQLSGNKILTVSGNGAPRGRCTLKHVFLTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVL

SEQ ID NO: 4336 - protein, 190 aa, Glycine max
MESATASSSESEMALPLPLASESQQPYVSELLSFTLDRLHKEPELLRVDADRIRRQMQEVAVGNYRSFIAAADALIAIRQEVSSIDNHLESLINEIPKLTSGCTEFIESAERILEKRKMNQTMLTNHSTLLDLLEIPQLMDTCVRNGDYDEALDLEAFVGKLSTMHPKLPGIQALAADVRLTTPSLLSQL

SEQ ID NO: 4337 - protein, 250 aa, Phytophthora infestans
MSRRYDGRTTTFSPEGRLFQVEYAMEAINNAGSAVGILAKDGIVIAAEKKTVSKLLTPSKTSEKTIKLDDHLICAVAGLTADANILVNYARLSAQRYELAYQEKEPCEQLVQTLCNYKQAYTQFGGQRPFGVSFLYAGWDRHHGFQLYHSDPSGNYGGWKATAIGANNRAAKSMLKSDYEEGMTVEEALAFSVKVMNKTMDSTSPSAEKLEFTTVTRNADGKIVHRQLTESETDELLKKAAADTASSGDM

SEQ ID NO: 4338 - protein, 493 aa, Agrobacterium tumefaciens str. C58
MRSKVMRRFQCYIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVAAIVPWNSQLFLAAVKIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLRTSDDPIPDPFVMR

SEQ ID NO: 4339 - protein, 101 aa, Glycine max
MAQSSGKTLVQWLVAALLIALLGGAQAVAICNIDSSQLNLCRAAVTGQNPPPPDEKCCAVIRQANLRCLCSYKSILPSFGINPKNALALPGKCGLQSPPNC

SEQ ID NO: 4340 - protein, 474 aa, Prochlorococcus marinus subsp. pastoris str. CCMP1378
MPKFEKLNLPKEGELITFNQGKPNVPNNPIVPYIRGDGTGVDIWPATQLVLDEAIKKSYGDERKINWFKVYAGDEACEIYGTYNYLPQDTIEAIRHFGVAIKGPLTTPIGGGIRSLNVALRQIFDLYSCVRPCKYYSGTPSPHKNPQNLDVIVYRENTEDIYMGIEWEADDHTCIDLINHLNNVVIPNSKNLKNRSIPDGSGIGIKPVSKLGSQRHIRKAIEHAKRLSGNKKHVTLVHKGNIMKYTEGAFRDWGYELAVNEFRADCITERESWILDNIHKNPEITIENNARKIEPGYDKLTSNKKAFICEEIKEVIASISNSHGNNKWEELIMVDDRIADSIFQQIQTRPQEYSILATLNLNGDYVSDAAAAIVGGLGMAPGANIGDNSAIFEATHGTAPKHAGLNKINPGSVILSGVMMLEYFGWNEAAKLVTSGISKAIEEKKVTYDLARLMEPKVAPLSCSGFAEAIISNF

SEQ ID NO: 4341 - protein, 335 aa, Staphylococcus aureus subsp. aureus Mu50
MSYIIIVTIAVVIFSLIFDFINGFHDTANAVATAVSTRALTPKTAILMAAVMNFIGALTFTGVAGTITKDIVDPFKLENGLVVVLAAILAAIIWNLATWFYGIPSSSSHALIGSIAGAAIASEGSFGVLHYQGFTKIIIVLIVSPIIAFCVGFLMYSIFKVIFKNANLTRANRNFRFFQIFTAALQSFSHGTNDAQKSMGIITLALIVANVQNDGSVEPQLWVKFACATAMGLGTAIGGWKIIKTVGGNIMKIRPANGAAADLSSALTIFVASSLHFPLSTTHVVSSSILGVGASNRAKGVKWSTAQRMIITWVITLLISALLAGLLFYILNLFF

SEQ ID NO: 4342 - protein, 438 aa, Alternaria alternata [sequence omitted]

SEQ ID NO: 4343 - protein, 592 aa, Xanthomonas campestris pv. campestris str. ATCC 33913
MAGRATDLRAGDRRLEPDRGRCVRGAGPKRPGRAMMRSVLMAAMLLYSGAACAAPAPGDYYGTLEPFAADAVYFVVTDRFVNGDTGNDHRDQGGAHRSFDVPTPCDGGVGDNIGYLGGDFKGIVDHADYIRGLGFGAVWITPIVDNPDEAFTGGKPITCESTLSDHGKTGYHGYWGVNFYRLDEHIPSPGLDFAGFTRSMHANDLKVVLDIVGNHGSPAYSMPVAQPGFGKLYDAQGRLVADHQNLAPAQLDPAHNPLHAFYNTSGGLAELSDLNEDNPAVLDYLAGAYLQWMEQGADAFRIDTIGWMPDRFWHAFVARIREKRPGVFMFGEAFDYDPAKIAGHTWARNAGVSVLDFPLKQQLSAVFGHKQAGFEQLATPLYLRKGPYGNPYELMSFYDNHDMARLDASDTGFIDAHNWLFTARGIPVIYYGSETGFMRGRAEHAGNRNYFGEERVSNAPQSPIFGPLQRIATLRRNTPALQRGVQVDLQLRGDQAAFLRVYQHAGMTQTALVLLNKGDAAADIAVSRLLQPGSWRDAFSGEQVQVQGRVTLQVPAHGVRVLLSDAPVTDVALRKQLDAQMADQAARDARNK

SEQ ID NO: 4344 - protein, 519 aa, Staphylococcus aureus subsp. aureus Mu50
MKIKAQVAMVLNLDKCIGCHTCSVTCKNTWTNRPGAEYMWFNNVETKPGVGYPKRWEDQEHYKGGWVLNRKGKLELKSGSRISKIALGKIFYNPDMPLIKDYYEPWNYNYEHLTTAKSGKHSPVARAYSEITGDNIEIEWGPNWEDDLAGGHVTGPKDPNIQKIEEDIKFQFDETFMMYLPRLCEHCLNPSCVASCPSGAMYKRDEDGIVLVDQDACRGWRYCMTGCPYKKVYFNWKTNKAEKCTFCFPRIEAGMPTVCSETCTGRMRYLGVLLYDADRVHEAASAVDEKGLYEKQLDIFLNPFDEEVIAQAEKDGIGYDWIEAAQNSPIYKLAIEYKLAFPLHPEFRTMPMVWYCPPLSPIMSYFEGKNTTQNPDAIFPAIEEMRLPIEYLANIFTAGDTEPVKGALQRMAMMRSYMRSQVTQQPFDTSRLERLGITERQTKDMYRLLGLAKYEDRFVIPTSHKETYLDTYHAQGSTGYNYGGEHFGDNCEGCGVAVGSGKTGQEIYNENFYGGIFRD

SEQ ID NO: 4345 - protein, 257 aa, Zea mays
  unsure (1)..(257): unsure at all Xaa locations
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDXFIESQVKKIAELRRLCAEKGVNPWIEVDGGVGPKNAYKVIEAGANAIVAGSAVFGAPDYAEAIKGIKTSQRPLAVAA

SEQ ID NO: 4346 - protein, 546 aa, Triticum aestivum
MGLDLGALALKYTGLAVSDHDSIVAINIFIALLCGCIVFGHLLEGNRWVNESTTALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 4347 - protein, 499 aa, Ruegeria sp. PR1b
MNAASFTKSFWHDEAKKLEFRTKHLINGEWVDSEDGTTFDTINPATGETIAKVASGKAADIDKAVKNARETFKSGVWSMLAPRERLAVIERFSALIEENAVEFALLDCLDMGKPVMDMINIDIPESVKNLKFFAETADKVHGSLTATDPSVVHYILRQPLGVVGLITPWNYPLMMAAWKLGPALITGNSVVLKPAEQAPLSCALLGDLFLKAGGPAGVLNVVQGLGEEAGKAIGLHPDVDKIGFTGSTEVGKLLMTYAGQSNMKRVTTECGGKTPQIVFADYDNLDKAVTSAVYGIYGNMGEMCNAGSRILVQRPIYDEFIKRFSELTASNMVVGDPLDPDTTIGPLVTVEQQERVLEYIEIGKKEGATLALGGGRGLNSGCYVEPTLFTDVTNSMRVAQEEIFGPVGTVIPFDTAEEALEIANDSLYGLAAAVWTNDLKTAHRFGRDLESGFVWVNTFDIGDMTSIWGGYKQSGNGRDTCIEALSQYTQTKSVWMDMA

SEQ ID NO: 4348 - protein, 520 aa, Helianthus tuberosus
MEIPYLLTVVLLLLTTLYLLLFTTLLLLFTTLYLLLRRRRSSTLPPTIFPYLPIIGHLYLLKPPLYRTLAKLSAKHGPILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 4349 - protein, 364 aa, Aquifex aeolicus VF5
MRVAIAGVGNCASSFIQGIYYYKKKGTVDVSGLMHEDIGGYKPWDIEIVAAWDIDARKVGKDVSEAIFAPPNCTAVFEPDVPHMGVKVRMGKVLDGFAPHMKEYPPERTFVLADEKEDELEDVVAVLKETQADVLINYVPVGAEQAARFYAEACLRAGVSFINAMPTFIVSDPEWAKKFEEAGIPVVGDDIKSQVGATIVHRVLTQLFVDRGVKLDRTYQLNFGGNTDFLNMLARERLKTKKISKTEAVTSLLPYDLGWENVHIGPSDWVPWLNDRKIAYIRMEGRLFGDVPMYIELKLDVEDSPNSAGSMIDAVRCAKLARDRGVAGPLYSISAYTMKHPPIQYPDWQAKKMVEEFIRGERER

SEQ ID NO: 4350 - protein, 305 aa, Agrobacterium tumefaciens str. C58 (U. Washington)
MRHRRCSMSLDRLAPAIFVFLWSTGWVTAKYAVYYTGPLTFLCLRYLLAGLLLWAICRFSGISWPKQRADVLRAILSGVFLHGIYLGMIWWAIGQGVPAAIGGIIAGLQPLMTAVAARFMIGERISPLQRAGLLLGFAGIAIAVLPKVMATGALGMSVPLYAVAVNVLGMVSVTYGTLYQKKYVHGGNIMAVATLQYVGALLVTVPFALLLEDGHVDWSLGLAATLGWSVGAISIGAVALLLYLIRRGQVSRAASLIYLVPPLAAVEAAVLFGETLTPAMIAGTVLAVTGVYLANRKPAASVAVR

SEQ ID NO: 4351 - protein, 417 aa, Nicotiana tabacum
AADGYARARGVGACVVTFTVGGLSVLNAIAGAYSENLPLICIVGGPNSNDYGTNRILHHTIGLQDFSQEPRCFQTVTCYRAVVNNLEDAHELIDTAVSTALKESKPVYISIGCNLPGIPHPTFSREPVPFALSPRLSNMMGLEAAVEAAAEFLNKAVKPVLVGGPKMRVAKASDAFVELSDACGYAVAVMPSAKGLFPEHHSHFIGTYWGAVSTAFCAEIVESADAYLFAGPIFNDYSSVGYSLLLKKEKAIIVQPDRVTIGNGPAFGCVLMRDFLAALAKRLKHNPTAFENYHRIYVPEGHPLKCEPKEALRVNVLFQHIQNMLSGDSVVIAETGDSWFNCQKLKLPKGCGYEFQMQYGSIGWSVGATLGYAQAAPEKRVIACIGDGSFQVTAQDISTMLRCGQRTIIFLINNGGY

SEQ ID NO: 4352 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 4353 - protein, 630 aa, Saccharomyces cerevisiae
APSFNVDPLEQPAEPSKLAKKLRAEPDMDTSFVGLTGGQIFNEMMSRQNVDTVFGYPGGAILPVYDAIHNSDKFNFVLPKHEQGAGHMAEGYARASGKPGVVLVTSGPGATNVVTPMADAFADGIPMVVFTGQVPTSAIGTDAFQEADVVGISRSCTKWNVMVKSVEELPLRINEAFEIATSGRPGPVLVDLPKDVTAAILRNPIPTKTTLPSNALNQLTSRAQDEFVMQSINKAADLINLAKKPVLYVGAGILNHADGPRLLKELSDRAQIPVTTTLQGLGSFDQEDPKSLDMLGMHGCATANLAVQNADLIIAVGARFDDRVTGNISKFAPEARRAAAEGRGGIIHFEVSPKNINKVVQTQIAVEGDATTNLGKMMSKIFPVKERSEWFAQINKWKKEYPYAYMEETPGSKIKPQTVIKKLSKVANDTGRHVIVTTGVGQHQMWAAQHWTWRNPHTFITSGGLGTMGYGLPAAIGAQVAKPESLVIDIDGDASFNMTLTELSSAVQAGTPVKILILNNEEQGMVTQWQSLFYEHRYSHTHQLNPDFIKLAEAMGLKGLRVKKQEELDAKLKEFVSTKGPVLLEVEVDKKVPVLPMVAGGSGLDEFINFDPEVERQQTELRHKRTGGKH

SEQ ID NO: 4354 - protein, 370 aa, Leptospira interrogans serovar lai str. 56601
MGVMIPFRSILNSLKSYEAGKPIELVVREFGIDPNRIIKLGSNENPFGCAESVMEVVRQAISKMSFYPDDSYLDLKTAIASKFDLTTDRIIPGNGSDQVLDFVCRCVLDQGDSVLINRITFAMYKIYALQCGAKIHSTDSVTHDLNAFLDLAKLIRPKIIFLCTPSNPAGDALSKSDVYEFLSKISLDTLVVIDAAYMEFGKKKDPNKFIPAKEVTDLFPNVFYTGTFSKVYGLGGMRIGYGIGNQELISNLYKMRPPFSVTNLSALAATEALKNESYVESYLENNWNEMKRYEKFAAEQSIEFIDSYANFITFFARKRGKSSSEIAHSLLKQGIILRDLKNYDLNALRITIGRPEQNDLVLEALEKEFH

SEQ ID NO: 4355 - protein, 255 aa, Zea mays
  unsure (1)..(255): unsure at all Xaa locations
FGSRHRVFLTDKYRPESCCIIANYYSLKGQHEKSVSYFQRALKLNRKYLSAWTLMGHEYVELKNSPAAIDAYRRAVDINPRDFRALYGLGQIYEMMGMPLYALYYFRKSPYLQPNDARLWIAMAQCYDSDPLQMIEEAIKCYERAANSTDTEGIALNQLAKLHGMMGQSEEAAFYYKKDLERMQVEXSQGQNFVEALLFLAKHYKSIGRFEDAEHYCTRLLDYTGPEKETAKNMLQGIKRLQSGFPSMDIDHFAL

SEQ ID NO: 4356 - protein, 896 aa, Oryza sativa
MAAAGEYSFAAEYDGPPLPYSLPRAIPLDLSRIPLASLSSPTSPPPPTAPPLPVVRPLTPSSLCSAIHGHRAGVSSAAAGAAAAQSSSSSSSAAASASAGGGGGVAGAAAVDSPTSVIENHHAALHHSAELPSTPSDDDENADEDDYDGRRAGAPPPPLLKSHHQPMVTFAETSGSLLQSSEDDDDDEEDEEEDEEYGEDAMPVRSSGSLSPAHWRGASKSRGCFRCGKGGSFWARGDKEACLACGARYCGGCLLRAMGSMPEGRKCLDCIGRPVAESKRDSLGRGSRVLRRLLSATEVELVMRSERECAANQLRPEDVYVNGTKLSPEELVMLQGCQCPPSKLRPGFYWYDKVSGFWGKEGHKPHCIISPNLNVGGALDQKASNGNTGILINGREITKSELQMLKLAGVQCAGKPHFWVNADGTYQEEGQKTVKGKIWDKPIVKLLSPVLSLPTPNKANNQCGEEPVNVVNRPIPDYLEQRTIQKLLLVGSGTNTILKQAKFLYKSRPFSVEECEDLRLIIQSNIYNYLGILLEGRERFEEEAIADRRTTCQSDPSSSGHCEPELCNDITEYYIAPRLKAFSDWILKAMAIGNLEDIFPAASREYAPMVEELWKDPAIQATYNRRSELPFLPSAASYFLDKAVDISRTEYELSDMDILYADGITSSDGLASTDFSFPQLALDGRGFDEPDPQDTLLRYQLIRINNKGLHENCKWLQMFDDVRLVIFCVAVSDYDEYYEDANGNVVNKMMETRQLFESIALHPIFEQMDFLLLLTKFDILEQKIGKSPLTSCDWFSDFTPLVSRNLINGTSKSSRGSSTGSTLAQMAGHYIAVKFKSVFQSFTERKLYVSYVNALDQESVRSAIRYGREIIKWEDEKPVFGSSETTYSEEPSSYSH

SEQ ID NO: 4357 - protein, 358 aa, Clostridium perfringens str. 13
MSINHGANLFDLSNELGINKKDIKDFSSNINPFGASKKAKDAILNNIDMVSIYPDPKYTDLKESISQYCHCKKENIIVGSGATELISSFISVINPKKALLLSPSYSEYESELEKINCEITKFFSKEEDNFKIDVNKLIDSINSSKFDLVIICNPNNPTGFAFSKDEISLLLKNTSSLFMVDETYVEFTEPEIYSSTPLVDIFNNLFVIRGTSKFFSTPGIRLGYGLISNKEIKKSMVEKLDLWNINIFATTMGEIMFKDKEYILSNTSKLKEERDYLFRELSSIKDLKVYESYSNFILCKITSKKFTANKLYNKLLEKGLIIRNCSSFEGLNEYFFRVCVLKPEDNKLLIENLKNLFL

SEQ ID NO: 4358 - protein, 308 aa, Oryza sativa
APIGSERQKRTADSAFHGPADMECTKITSDDLPLPMMSEMDEVMGSELKEIEMEDIEEAAPDIDSCDANNSLAVVEYVDEIYSFYRRSEVHYKLELLDETLFLTVNIIDRFLARENVVRKKLQLVGVTAMLLACKYEEVSVPVVEDLILICDRAYTRTDILEMSDRYMFREVKVSFVFVQERMIVNTLQFDMSVPTPYCFMRRFLKAAQSDKKCLLKQLELMSFFIIELSLVEYEMLKFQPSMLAAAAIYTAQCTINGFKECSKMMVELHQKAGHGKLTGVHRKYSTFRYGCAAKSEPAVFLLKSVAL

SEQ ID NO: 4359 - protein, 333 aa, Mycobacterium leprae
MSRAKLVYRPPLELIETNQFKGEKSLVDSAAQSNQAQSVFGQTGTARVKRGMAEMLKGGVIMDVVIPEQARIAEGSGAVAVMALERVPSDIRAQGGVSRMSDPDMIESIIAAVTIPVMAKARIGHFVEAQILQSLGVDYIDESEVLTPADYTHHIDKWKFTVPFVCGATNLGEALRRINEGAAMIRSKGEAGTGDVSNATTHMRAIAGDIRRLTSLSEDELYVAAKELHAPYELVIEVARTNKLPVTLFTAGGIATPADAAMMMQLGAEGIFVGSGIFKSSDPAQRAAAIVKATTFYDDPDVLAKVSRGLGEAMAGIDVEQIAQPDRLAQRGW

SEQ ID NO: 4360 - protein, 260 aa, Oryza sativa (japonica cultivar-group)
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 4361 - protein, 224 aa, Prunus persica
  unsure (1)..(224): unsure at all Xaa locations
MTVEMHAGLASEGGSKLKMIISYVDNLPTGTEKGLFYALDLGGTNFRVLRVQLGGKVRGIISQEFTEVSIPENLMVGTSDALFDYIAAEVAKFVAKEGQXYQLPPGRQRELGFTFSFPVLQSSINSGTLIKWTKGFSIDDAVGQDVVAELSKAIEKQGLDMRVSALVNDTVGTLAGGRYVNGDVVAAVILGTGTNAAYVERAHAIPKWHGLLPKSGEMVINMEW

SEQ ID NO: 4362 - protein, 189 aa, Triticum aestivum
LVCITAGAGLVHTWAAVLMGICAGSVPWFTMMVLHKRSFLLQKVDDTLAVFHTHAVAGLLGGVLTGLLATPELTTLHTHVPGTRGAFYGGGIQQVGKQLAAALFVVAWNVVVTTGIILAVGLVIPLRMPDEQLRIGDDAAHGEEAYALWGDGERFDVSRRAAARATEVGDQSVDQRLAAMGARGITVQL

SEQ ID NO: 4363 - protein, 690 aa, Neurospora crassa
MEEGSVNYGTPNNGASPSANPILAQPPLPDSTAGNQSEDVQMGEGPEPTIKQDDSTPAPGAASATPLDASEGAGVAATAPEDEEMGDAPKEETAQNGDGASANEGSGDVAKTKEQIGNAAREHVISQTHAIILPSYSTWFDRNTIHNIERKALPEFFNNRNRSKTPAVYKDYRDFMIDTYRLVPYEYLTVTACRRNLAGDVCAIMRVHAFLEQWGLINYQVDADQRPSHVGPPFTGHFKIIVDTPRGLQPWQPAADPALVEGKPSKDTEAKATATPVPKNEQTLELGRNIYEANAKNNKLNKTNGETPAANGASEADALTKAPIAKVICCNCGIDCTRIYYHSSQADVNSKTKYDMCPSCYLEGRLPANQTNASYTRMENPTYTSILDRDAPWSDAETLRLLEALERYDDDWGEIAEYVGTRTREECVLQFLQLDIEDKYLESEKLDAPVGLQMLGSHGGQLPFSQVDNPVMSVVGFLASLADPASTAAAAGKSAELLKQGLRNKLEGGAENTESEDKGKEKEKSGDSMEVDVRHETTTTTTTVSTTTTTTKTSALANIPLATMGARAGGLASHEEREMTRLVSAAVNVTLEKMELKLKYFNEMEAILQAERRELERARQQLFLDRLSFKKRVREVQEGLKAAAAVGGEQGVKLAQEALTDGQRMSFHAPPAVGSVQPLSAEGQVKTYEA

SEQ ID NO: 4364 - protein, 188 aa, Triticum aestivum
  unsure (1)..(188): unsure at all Xaa locations
MARPRAWAPFPGSALSLLSVLLLLVGRRGAAGGGGGRGSSVYPAPVVYPHHSRQISWHPRAFLYPHFLTDDEANHLVSLARAELKRSAVADETSGKSKLSEVRTSSGTFSKGQDPIVAGIEDKIQLLLVXEDKIAAWTFLPKENGEDMQVLRYKRGEKYEPHHDFFTDSVNTIRGGHRVATVLLYLTD

SEQ ID NO: 4365 - protein, 159 aa, Buchnera aphidicola
MANILLLDNIDSFTYNLVDQLRKHNNNVVIYRNTVDIKIISHVLRQLINPILMLSPGPGLPRDAGCMPELIKKNKGQLPIIGICLGHQAIVEAYGGHIQYAGEIFHGKVSLITHDGLEMFKNVSQYVPVARYHSLICSNVPKDFVINSYFNQMVMSVRH

SEQ ID NO: 4366 - protein, 631 aa, Pseudomonas syringae pv. syringae B728a
MSQANSHAEAGGAAKPIGLLIAAVGVVYGDIGTSPLYTLKEVFQGGYGVDVTHDAILGVLSLIFWSLIWVVSFKYMAFVLRADNQGEGGIMALMALARRASAKHPRLQMMMVVFGLFGAALFYGDSMITPAVSVLSAMEGLELAFDGLDHWIVPMALIVLVGLFLIQRHGTARIGVLFGPVMVTWFLVLGALGVYGIMQSPEVLKAVNPAWGVNFFIIHPGIGVAILGAVVLALTGAEALYADMGHFGRKPISRAWFILVLPALLLNYFGQGALVLGNPETVRNPFYLLAPGWALLPLIGLSTMATIIASQAVISGAFSMTLQAIQLGYIPRMHIQHTSSDAQGQIYIGAVNWALMAGVILLVIGFESSGALASAYGVAVTGTMLCTTILVSTVMLMLWKWPPLLAVPLLICLLLVDGLFFAANVPKIFQGGAFPVLAGAVLFILMTTWKRGKQLLAERIDEGGLPLPIFIGSIRVQPPHRVQGTAVFLTARSDAVPHALLHNMLHNQVLHEQVVLLTVVYEDSPRVPSAQRFEVESYGEGFYRVILHFGFIDEPDVPAALALCHLPELDFSPMRTTYFLSRETVIPSKMDGMARWREALFAFMLKNANGNLRFFKLPFNRVIELGTQVEM

SEQ ID NO: 4367 - protein, 176 aa, Bacteroides thetaiotaomicron VPI-5482
MIMSKETLIKSIREIPDFPIPGILFYDVTTLFKDPWCLQELSNIMFEMYKDKGITKVVGIESRGFIMGPILATRLNAGFIPIRKPGKLPAEVIEESYDKEYGTDTVQIHKDALDENDVVLLHDDLLATGGTMKAACELVKKLKPKKVYVNFIIELKDLNGKSVFGDDVEVESVLTL

SEQ ID NO: 4368 - protein, 320 aa, Listeria seeligeri
MYIHRSRKVLLVLLCLAVYSIIFPMHGKAISSKTWNTFTKKNINTQRWMTSLPDSVSLSALSIPGTHDTMSYNGYITWQFTRPLAQTQTMTLNEQLNAGIRFFDIRAKEDLNIYHGPIYLNASLEEVLHTFISFLKENPKEVVIMRLKDENKSENSFDYRIQPLIHKLKSFFYTESAKNTSSKTPTLRKLRGKILLLSDNNTKKSLVINSSRYGMQYDSSEQVIQDDYNGPDVNTKYQEIVQTAYQACRQSSSENKLFLNYVSATSLTFTPSQYADKLNSKVENFVDNLTANKLNGVGMLIMDFPEKQTIHSIIKNNKFN

SEQ ID NO: 4369 - protein, 469 aa, Rhizobium leguminosarum bv. viciae
MATASEILKQIKENDVKFVDLRFTDRRASLQHVTMDVVCVDEDMFADGVMFDGFSIGGWKAINESDMVLMPDTETVHMDPFFAQSTMVIVCDILDPVSGEAYNRDRRGTAKKAEAYLKASGIGDTVFVGREAEFFVFDDVKYKADPYNTGFKLDSTELPSNDDTDYETGNLGHRPRVKGGYFPVPPVDSAQDMRSEMLTVLSEMGVVVEKHHHEVAAAQHDTLVRNADELGIKFKMQIYKYVVHQVANAYGKTATFMPKPIFGDNGSGMHVHQSIWKGGKPTFAGDEYAGLSESCLFYIGGIIKHAKAINAFTNPSTNSYKRFVPGYEAPVLLAYSARNRSASCRIPFGSNPKAKRVEVRFPDPTANPYLAFAAMLMAGLDGIKNKIHPGKAMDKDLYDLPPKELKKIPTVCGSLRQALESLDKDRKFLTAGGVFDDDQIDAFIELKMAEVMRFEMTPHPVEYDMYYSA

SEQ ID NO: 4370 - protein, 1938 aa, Bacillus sp.
MKKRFQRGMAGLLSILLIVSMFAGYLPARAAAETGDKRIEFSYERPDGNYEGWNLWVWGTGVKDDQIDFTEFKEGKAYADIAVSDNADKVGFIIRKGDWEEKDFDGDRSITINKIDNITKVHVTSQQEKFGQIPDGSPPVVADGNADFFFRDKELYAAGEMDKVEKVELSILGEKYEMNGEPEKERFTYTLSDLPTGEHEYTYLVTVDGQTEEVTDPYNTVDGRSVVEYVTSDVQVSASFIPAKVDYNQNAVVKVDIESETETKIREMSINLSEIGGKEKATIDPALNELTVAVKQGVTAGVKNLPITAIDEFGNRHEGSATLEVQARTITGEKADFDWDQSVVYFMLTDRFFDGDSSNNDPHGIGYDTSKSGTYQGGDFKGITQRLDYLDELGINTIWISPVVDNIKFDVRHSEGPDTPYYAYHGYWADNFGELNPHFGSMADFHEMIDAAHERGIKIMVDVVLNHTGYGLKPGDSSSVANFPTDEDRARFDGMLRDGGSGEVRGELAGLPDFLTENPDVREQVVQWQTDWIEKSRTAKGNTIDYFRVDTVKHVEDTTWMAFKNALTKAMPEHKLIGEAWGANVNDDLGYLNSGMMDSLLDFDFKNYARDFANGQLDAVQQKLEARNSKLNNTATLGQFLGSHDEDRFYEVVEGDLGKYQVAASLQLTAKGQPVIYYGEELGLPGKNDYPYYTNRQNMPWDDVDGNEILEHYQKLLAFRNDNPNTFAKGDRKKVAGSDSEGYLLFSRTYGENSVYVGLNTEAAAKDVTLNFGSSEAVVTDRYSGQEYQANEEGQVTFSIPAMEDGGTVLLEVENGAVPPVEEEPTEPGEIEENTLRIHYQRTDNSYENLGLWLWGDVAAPSENWPSGGTPFQAGNVTDYGAYVDVELAEDAQNIGFLVLNTTNGDKDGGDKAVELFSPDLNEIWIKQGSDEVFLYEPVDLPANTVRIHYERTNADYEGWGLWNWEDVESPSDGWPNGAADAAGIGKYGAYYDIKLKEDANKIGFLFVNKQSGGQTGDMTFDMLKQYNQLFVKEGEDKVYTNPYGTVPLALVSGEVLSDKLISLTFTRTEGLDLEELKEQLEIKDVDGNDVSFTDVTIEGEKTVHVHGEFDLEKIPFSVTYLDRTISVKSGWKLIDEMYAYDGKLGAELHEDGTATLKVWSPKADNVSVVLYDKVDQNEVVDTIEMVKGDRGVWSVKLTKDNTGLDSLKGYYYHYEITHGDVTNLALDPYAKSMAAWNNEAGDKVGKAAIVDIGSIGPELDYADIPGFEKREDTIIYEVHVRDFTSDPNIGEDLKAQFGTFASFVEKLDYIQELGVTHIQLLPVMSYYFSNEFESGERMLEYASTGTNYNWGYDPHNYFSLSGMYSENPEDPELRIKEFKNLINEIHKRDMGVVLDVVFNHTAQVHIFEDLVPNYYHFMDADGTPRTSFGGGRLGTTHEMSRRVLVDSIKHWVDEYKVDGFRFDMMGDHDAESIQIAFDEAKKLNPNIVMIGEGWVTFAGDEGEPVQAADQQWMQYTEAVGSFSDEFRNELKSGFGSEGQPRFITGGAVNVQQIFDNIKAQPHNFMADQPGDVVQYIEAHDNLTLYDVIAQSIKKDPEIAENDLEIHKRIRVGNAMVLTSQGTAFLHAGQEFGRTKQWRAPATEAPYKSTYMTDADGNPFVYPYFIHDSYDSSDIINRFDWEKATDAEKYPVNNVTRDYTAGLIELRRSSDAFRLGSRELVDSNVTMVDAPEIKEQDLVVAYRSVSTAGVEYYTFVNADTSSRTLTLGQDLTEGVVVVDAEEANVAGVAEPAGFELTAEGITLEPLTTVVVRVGEQEGTDPGDGDGDGNTPPPGDGDGDGNTPPPGDGDGDGNTPPPGNGNGNNPGTPPGKGGENPGKGKNDKTPPGKGGDNPGKGNKLPLTATGTLNYILFGAIMLVLGTLLYLGVRRKAGLKEKTL

SEQ ID NO: 4371 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEKGXXXXVGAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLL

SEQ ID NO: 4372 - protein, 544 aa, Glycine max
MTTHIDNLWVLALVSKCTQENIAWSLLTIMVTLWLSMTFFCWSHPGGPAWGKYYSFHYWKKTTTTTTSTSNNTNSNNLKMIPGPKGYPFIGSMSLMTSLAHHRIAAAAQACKATRLMAFSMGDTRVIVTCHPHVAKEILNSSVFADRPIKESAYSLMFNRAIGFAPYGVYWRTLRRIAATHLFCPKQIKASELQRAEIAAQMTNSFRNHRCSGGFGIRSVLKRASLNNMMWSVFGQKYNLDEINTAMDELSMLVEQGYDLLGTLNWGDHIPFLKDFDLQKIRFTCSKLVPQVNRFVGSIIADHQADTTQTNRDFVHVLLSLQGPDKLSHSDMIAVLWEMIFRGTDTVAVLIEWILARMVLHPEVQRKVQEELDAVVGGGARALTEEVVAATAYLAAVVKEVLRLHPPGPLLSWARLAITDTTIDGYHVPAGTTAMVNMWAIARDPEVWLDPLEFKPERFMGLENEFSVFGSDLRLAPFGSGRRTCPGKTLGLSTVTFWVAWLLHEFEWLPSDEAKVDLTEVLRLSCEMANPLIVKVRPRHGLST

SEQ ID NO: 4373 - protein, 211 aa, Glycine max
AYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIFSYNHLGNNDGMNLSAPQTFLSKEISKSNIINNIVNINTILYKPNEHPNHIIIIKYIPYIRDSKKTIDNYTSEIFIDRKNTIILHNTYKDSLLSTPIILDLMLLTDLITRIQV

SEQ ID NO: 4374 - protein, 950 aa, Oryza sativa
MSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLGAFWNVAGVFALTILIPSVAKERASPEFIFTHFNTENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNAESPAAAFSTARSREGAVDDPRAVEEHGDQEPAANGVDQAAAANGGNQAVAANGQPPRSPAAALAAEVACCSGVCTTSSPRTPSTATTRHQRHCSRHPMPLFFYRLDHWAYPDRVASTSAASTSPPASPTRSFASPTPTPTSAVCRTPGHLLHARAPSAPPAGRSPHRRLVLRQARAAAPPVARRRPLRPQLLPSPAAAITAAASPASPSNWREGETGGTRPAEGRLPLSSPRPLDADADVEAVPELTVVDPDGEATETAGGGRRRPSGGGGAPVPLLDLGHYAGVDEVGSGGGPRAPSGVSSARRRPHRRRGERHSRERQMWVMANDAALQKVAREGNLDVALLLQCVKPALRREGGNTQLATWTASTPLCLWRGLRWSTAATLSPPNPRRPLHNPCRRPCCRILGASA

SEQ ID NO: 4375 - protein, 570 aa, Oryza sativa (japonica cultivar-group)
MSSSGGGGVAEEVARLWGELPVRVVWAAVAAQWAAAAAAARAAVVVPAVRALVAVSLAMTVMILAEKLFVAAVCLAVRAFRLRPDRRYKWLPIGAAAAAASSEDDEESGLVAAAAAFPMVLVQIPMFNEREVYKLSIGAACSLDWPSDRVVIQVLDDSTDLVVKDLVEKECQKWQGKGVNIKYEVRGNRKGYKAGALKEGLKHDYVKECEYIAMFDADFQPESDFLLRTVPFLVHNSEIALVQTRWKFVNANECLLTRFQEMSLDYHFKYEQEAGSSVYSFFGFNGTAGVWRIAAIDDAGGWKDRTTVEDMDLAVRATLQGWKFVYVGDVKVKSELPSTFKAYRFQQHRWSCGPANLFKKMMVEILENKKVSFWNKIHLWYDFFFVGKIAAHTVTFIYYCFVIPVSVWLPEIEIPLWGVVYVPTVITLCKAVGTPSSFHLVILWVLFENVMSLHRIKAAVTGILEAGRVNEWVVTEKLGDANKTKPDTNGSDAVKVIDVELTTPLIPKLKKRRTRFWDKYHYSEIFVGICIILSGFYDVLYAKKGYYIFLFIQGLAFLIVGFDYIGVCPP

SEQ ID NO: 4376 - protein, 270 aa, Oryza glaberrima
MGRRACCAKEGMKRGAWTSKEDDMLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAATTTTVWAPKAVRCTRGFFFHDRETAPLAAAAPAPAGELGDGDDADCDYYCSGSSSAATTTSSSSFPAVVEPCFSAGDDWMDDVRALASFLDTDDAWNLCA

SEQ ID NO: 4377 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 4378 - protein, 491 aa, Bacillus anthracis str. A2012
MKIKAQVGMVMNLDKCIGCHTCSVTCKNTWTNRPGAEYMYFNNVETKPGIGYPKQWEDQEKYKGGWELKNGEIQLKSGSKMKRLMNIFHNPDQPTIDDYFEPWNYDYETLTTSPQRKHQPVARPKSAITGEFIDKIEWGPNWEDDLAGGHITGLQDPNVKKMEEEIKTDFENVFMMYLPRICEHCMNPSCVSSCPSGAMYKREEDGIVLVDQNACRAWRFCVSSCPYKKVYVNWQTNKAEKCTMCFPRIEAGMPTICSETCVGRIRYIGVMLYDADKVKEAASVENEKDLYESQLTVFLDPNDPEVVAEAKKQGIPEEWIKAAQESPIYKMIIDWKIALPLHPEYRTMPMVWYIPPLSPIMNMVEGKGSNWQAEEIFPAIDNMRIPIQYLANLLTAGDESHIRLTLKKMAVMRTHMRALQINKEPNEAVLKELGLTKQDVEDMYRLLAIAKYKDRFVIPTSHREQVADLYNEQGSCGLSFAGGPGSCMTIS

SEQ ID NO: 4379 - protein, 359 aa, Nostoc punctiforme
MALVPLRLLLDHAAENGYGIPAFNVNNLEQIQAILKAAVETDSPVILQASRGARNYAGENFLRHLILAAVETYPHIPIVMHQDHGNAPATCYSAIKNNFTSVMMDGSLEADAKTPASFEYNVNVTREVVNVAHALGVSVEGELGCLGSLETGAGEAEDGHGFEGTLDHSQLLTDPDEAVDFVEATQVDALAVAIGTSHGAYKFTRKPTGEILAISRIEEIHRRLPNTHLVMHGSSSVPEDLLALINQYGGAIPETYGVPVEEIQKGIKSGVRKVNIDTDNRLAITAAVREALAKKPEEFDPRHFLKPSITYMQKVCAERYQQFGTAGNASKIKQISLEDFAAKYAKGELNVVTKSAAKV

SEQ ID NO: 4380 - protein, 583 aa, Aspergillus niger
MGVSNMMSRFKPQADHSESSTEAPTPARSNSAVEKDNVLLDDSPVKYLTWRSFILGIVVSMGGFIFGYSTGQISGFETMDDFLQRFGQEQADGSYAFSNVRSGLIVGLLCIGTMIGALVAAPIADRMGRKLSICLWSVIHIVGIIIQIATDSNWVQVAMGRWVAGLGVGALSSIVPMYQSESAPRQVRGAMVSAFQLFVAFGIFISYIINFGTERIQSTASWRITMGIGFAWPLILAVGSLFLPESPRFAYRQGRIDEAREVMCKLYGVSPNHRVIAQEMKDMKDKLDEEKAAGQAAWHELFTGPRMLYRTLLGIALQSLQQLTGANFIFYYGNSIFTSTGLSNSYVTQIILGAVNFGMTLPGLYVVEHFGRRNSLMVGAAWMFICFMIWASVGHFALDLADPQATPAAGKAMIIFTCFFIVGFATTWGPIVWAICGEMYPARYRALCIGIATAANWTWNFLISFFTPFISSSIDFAYGYVFAGCCFAAIFVVFFFVNETQGRTLEEVDTMYVLHVKPWQSASWVPPEGIVQDMPAPLPLPSRRVRLRWLSTPSPLSSASKPLALARTHFASCSCTLNLHLKL

SEQ ID NO: 4381 - protein, 562 aa, ASPERGILLUS NIDULANS FGSC A4
MGVDIKGLFKPKAEQQEHSQATTPSRTDSIAEKDNGIIDDSPVKYLTWRSFILGIVVSMGGFIFGYSTGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGIFISYIINYGTESIQSTASWRITMGIGFAWPLILGLGALFLPESPRYAYRLGRIDEARKVMAKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASVGNSVLDLDNPQNTPKAGAAMIVFTCFFIAGFATTWGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVRDLHPGSDANKTEGLGQAEHGEESRPEPVEIRE

SEQ ID NO: 4382 - protein, 464 aa, Glycine max
  unsure (1)..(464): unsure at all Xaa locations
KNSKLCKKVKTAANNGNDQGREQLARSFDSRGNPTVEVDVILSDRTFHRAAVPSGASTGDYEALELRDGGSDXLGKGVLKAVENVNSIIAPAXVARDPTKQTEIDNFMVQQLDGTVNEWGXWCKQKLGANAILAVSLSVCKADAAVKKIPLYQHIVNPAGNKNLILLVPSFNFINGGSHAGNKIAMHXFMIITEGXSSFQKAMIIVIEGLXNIILKGLLFRRSMNRMRVNVVHVMSIXTNEMENNVYLKLIXSELLKDXHENMKLVGMDHATRQCDEKMVRNYRXNIMEQNNDESLQIXGKHXKDINKVMFVEFSNGVXEKSLNHDDRLLCAKLXLKVRSKCRLLLIIYRRYQPXHVVKSIKEKAYNALLLKVNQIGSVTEXIEALRMSKQAGWGVMASHRSGETEDTFIADLSVGLATGQIKTGAPCRSERLAKYNQLLRIEEELGSAAVYAGAKFRAPVEPY

SEQ ID NO: 4383 - protein, 423 aa, Aquifex aeolicus VF5
MRALGFIGIILSIFSSFAYASEAKLDTGNTAWMLVASALVVFMTVPGLALFYGGLDKSKSILNTIAMSFSAFAVVTLTWIFVGYSVAYGDDIFGFIGNPFQYVLGKGISGINSDTGYPALLDLMFQLTFATITTALISGSFVGRMKFSAWILFAILWSVFVYPPVAHWVWGGGFLANDGALDFAGGTVVHINAGIAGLVGALILGRRKDTSLIPNNVPLVALGAGILWFGWFGFNAGSALGANESAAWAMINTTVATSTAALAWMFTEWLHVGKPTVVGISSGIVAGLVAITPAAGFVNLIGSIFIGAIASVCAYFMVALVKPKFGYDDALDVFGIHGVRGIVGAVLTGVFADPNVGGTPGLLYGNPKQVLIQIEGVIATILYSAILTAVILLVLKAVVGLRVSEEEELELDSSLHGEKAYNL

SEQ ID NO: 4384 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVKRFADSLGHPKVSQELRSIWIDLLAKCDASLGMKIATRLNMKPNM

SEQ ID NO: 4385 - protein, 506 aa, Pseudomonas aeruginosa UCBPP-PA14
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 4386 - protein, 282 aa, Campylobacter jejuni subsp. jejuni NCTC 11168
MCSFSFEVFPPRKDENIKNLHAILDDLGQLSPNFISVTFGAGGSINSQNTLEVASLIQEEYQIPSIVHLPCIHSSKEKITQILQKCKEKNLNQILALRGDICENLKKSKDFSYASDLISFIKKQEYFEIYAACYPEKHNESKNFIEDIHHLKTKVNAGTDKLITQLFYDNEDFYTFKQNCALADIDIPIYAGIMPITNKRQVLKISQLCGAKIPPKFVKILEKYENNTLALEDAGIAYACDQIVDLITSGVDGIHLYTMNKSKAAIKIYEAVKHLLKEELHA

SEQ ID NO: 4387 - protein, 367 aa, Novosphingobium aromaticivorans
MASTADTTGLTFTRNPHPAPVAADARAQVLANPGFGTTFTDHMVEIDYAEGQGWHDARVVPYGPIALDPAAAVLHYAQEIFEGLKAYRLADGGIALFRPEANAQRFNASARRLAMPELPEDLFVEAVRQQVLADKDWFPTVEGGSMYLRPFMFASEAFLGVRPARQYKFMVIASPAGNYFKSGAPAVSIWVSDYTRAAPGGTGAAKCGGNYAASLVPTAEAFSRGHDQVLFLDAAEHKWVEELGGMNLFFVFDDGSILTPELTGTILPGITRSSLLTLAAEEGLTVREGRYSLDQWKADAASGKLIETFACGTAAVVTPVGKVASRDGEFTIGSGGPGQLTQKLRQKLVGIQRGEIADTHGWVSRIA

SEQ ID NO: 4388 - protein, 523 aa, Desulfitobacterium hafniense
MLSYNMHSLPKTLSELYSPEMDIFPSPVYHIFLKSFSKVTGRKDSSVELTLRQTLKKRGAPMSVMETTHRQYRQTLIFGLIRIVEELFPQEEIKIQYSILDGIYCELENSPLSPREVAQIEEKLHHWLESKPKIMSCAEEDGFFHTKVNHIFVKSLYPAMHPADTYYPFTLIFYHPGFILLFSNPEHPCELPNFVPPEKLAATFLESQRWVENLHLDKVGSINLNIRKGKTTELISLAEALHEKKISLIADRILEQRRNLRIILISGPSSSGKTTFAQRLSTQLQVNGIRPIALSLDNYFCDREHTPLDEYGQYDFEALEALDLPLLNQHVKALIHGEEIECPIFDFVAGRRQPEGIRMKLEPDEILVMEGIHALNPRLLPSLERSHLFKIYISALFQPNIDTHNRISTTDVRLIRRLVRDDKYRGINPEKTLNQWSSVRRGENNNIFPYQEEADVMFNSSLLYELNALKAYAEPLLISIPKDHPYYATASHLLRVLYHFEILDIAKVPFNSILREFIGGGIY

SEQ ID NO: 4389 - protein, 151 aa, Picea glauca
MAMDPLLSTVQQLLGVPDDLERILHAPTRSYTRDTEATASTPVDVKEYPNSYVFIVDMPGLKSNDIKVQVEDENVLNISGERKRNEKEEGEVKYIRMERRVAKFMRKFSLPADCNLEAISAACQDGVLTVTVPKLPPPEPKKPKTIAVKIG

SEQ ID NO: 4390 - protein, 489 aa, Saccharomyces castellii
MSADFGLIGLAVMGQNLILNAADHGFTVCAYNRTVSKVEHFLANEAKGKSIVGATSIDDFLSKLKRPRKVMLLVKAGAPVDALINELVPRLEKGDIIIDGGNSHFPDTNRRYEELKQKGILFVGSGVSGGEDGARYGPSLMPGGAEEAWPHIKDIFQSISAKSDGEPCCDWVGPAGAGHYVKMVHNGIEYGDMQLICEAYDIMKRVGHFTDKEIGDVFETWNKGVLDSFLIEITRDILKFNDVDGKPLVEKIMDTAGQKGTGKWTAINALDLGIPVTLIGEAVFSRCLSALKSERIRASKTLLGPEVPKDLIKDKKQFVDDLEQALYASKIMSYAQGFMLIREAGKTYGWKLNNPAIALMWRGGCIIRSVFLGEITKAYREDPELENLLFNKFFSDAVTKAQTGWRKSIALATTYGIPTPAFSTALAFYDGYRSERLPANLLQAQRDYFGAHTFRVLPECASDNLPLDKDIHINWTGHGGNVSSSTYQA

SEQ ID NO: 4391 - protein, 475 aa, Arabidopsis thaliana
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 4392 - protein, 137 aa, Eremothecium gossypii
MTDQEDTPRDVRLLHLLLASQSIHAYEDQVPLQLMDFAHRYTRGVLKDAMMYNEYANNGSAPADLTVEDVRLAIGSRTQYQFKPTAPKELLLQLAQERNKKPLPQVMSMWGVRLPPEKYCLTAKEWQLDEELAEDPV

SEQ ID NO: 4393 - protein, 550 aa, Zea mays
MAATVRRAASSVLSRFLLTKPSPSPASAAGNNSALLGSGAAALHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALSSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 4394 - protein, 396 aa, Campylobacter jejuni subsp. jejuni NCTC 11168
MLMSYEESLKILHSHIKTYEKIEKIALTECLGRILAQDIKAPKNQPEFPTSAMDGYAIKFEDQDKPLKILGLTPAGTMPQFSVQNGTCVKTFTGSLMSEGSDTLVPVENIRIENNTLFIEKKVPQAFAVRAVGENYKKDEILLKKGTRLNYSEIALLAELGFFHISVFIKPIVGVLSSGSEIKDLGEALENPAQIRSSNHIAIANLAKNLNCDTRVFPLLKDDEKATFSTLESALQSCDILVTTGGVSMGDFDFLKKAIKEYEIIIDKADIKPGRHIKIAKANEKFIIALPGFPYSAMVMFNLYTREILNSWLLQPKDYICKAFLQGSYKKKTPYLEFVACNIEFKNGRILANLEGKKEGSSAIINNLNNKAALMVVPKECEMLENESLVDIIFMP

SEQ ID NO: 4395 - protein, 395 aa, Glycine max
MALSRVAQSSPSQSNLLKPLSSYLSLRRRSVSTSSEPLTVETSVPFTSHNCDAPPRAVETSSAELFSFFRDMALMRRMEIAADSLYKAKLIRGFCHPYDGQEAVAVGMEAAITRKDCIITAYRDHCTFLARGGTLIEVFAELMGRRDGCSKGKGGSMHFYRKEGGFYGGHGIVGAQVPLGCGLAFAQKYCKDENVTFSMYGDGAANQGQLFEALNISALWDLPSILVCENNHYGMGTAEWRAAKSPSYYKRGDYVPGLKVDGMDALAVKQACKFAKEFALKNGPIILEMDTYRYHGHSMSDPGSTYRTRDEISGVRQERDPIERVRKLLLTHEIATEKELKDIEKEIRKEVDEAIAKAKESQMPEPSDLFTNVYVKGFGVEACGADRKELRATLP

SEQ ID NO: 4396 - protein, 400 aa, Physcomitrella patens
MKRRNECEEHHVEMNGWNGYTNSDLSPAPTPTGPRGRGSRAKTVKQTKNGPQTPGPSGIGSPTSSAPTPTSTCRYDSSLGLLTKKFIDLIKQADDGVLDLNKAADTLHVQKRRIYDITNVLEGIGLIEKKLKNRIRWKGLGMVRNAEAKDDAAGLLAEVEDLRIKEKKLDESISEMRERLRSLSEDEHNKQWLYVTEDDIKNLHCFQNETLIAIKAPLGTTLEVPDPDEAVEYPHRRFQILLRSTLGPIDVYLVSRFEGRTEVPMETLPDSQEAGPSSSVDGMSHQENMVMVPEVGYGLSDLVPPVSHESASQAPEPTGSHPDFAGGIMRIAPAEVNTDTDYWLLSDAGVGISDMWRSDPSNAMWDEVVRLNPEFGSENIGSPRPHTPPSNNALEVDPVS

SEQ ID NO: 4397 - protein, 509 aa, Oryza sativa (japonica cultivar-group)
MQPMATANLLYAALLVPTVLYLAVTRRRSRRLPPGPVGLPLVGSLPFIDPNLHTYFASLAAKHGPILSIRLGSKVDIVVNSAQLAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRLSKPELYYS

SEQ ID NO: 4398 - protein, 419 aa, Neurospora crassa
MADQGGSNHGIARTSRTRTEEQRQKDLERIKDYRALEDQVRHHAAKNDYSSDVFALTSKLLRLNPEYYTVWNVRRRCLISGLLSKPSPGSSPSKALPTSSPTATTTTSSADFSSSLSTETPPAPESQTTGKSGITAEDDEEQKQQTRQQDQQNDQQILQKELHFTIPLLLESPKCYWIWSYRLWILKQVIERLPVPVARNIWEEELGLTSKMLLRDQRNFHAWGYRRHVVEQLESPELEGKSLVESEFEFTTKKISQNLSNFSAWHSRSKLIPRLLDERNANDEARKAFFEEELNKIGEAINVGPDDQSLWYYHQFLMLNLVNSAEHPTIAPAFTQEERVTYLRREIESIQELLEDYDDAKLIYEALFDYTLYLCQLQGRKPNEQEEKDLKGWLGNLKKLDPMRSGRWADLERDLGLKE

SEQ ID NO: 4399 - protein, 318 aa, Sphagnum cuspidatum
  unsure (1)..(318): unsure at all Xaa locations
KVGINGFGRIGRNFIRCWHGRKDSPLEIVVINDTGGLKQASHLLKYDSMLGTFAADVKVDGNDSISVDGKTIKVVSDRNPLNLPWGELGIDLVIEGTGVFVDKEGAGKHLKAGAKKVLITAPGKGAIPTYVVGVNADEYNHGDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGPLKGILAVCDEPLVSVDFRCSDVSSTIDSSLTMVMGDDMVKVVAWYXNEWGY

SEQ ID NO: 4400 - protein, 326 aa, Streptococcus pyogenes SSI-1
MEAEMVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGIPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 4401 - protein, 347 aa, Oryza sativa
  unsure (1)..(347): unsure at all Xaa locations
MEAEKKPPAVSDVGAWAMNVVSSVGIIMANKQLMSSSGYAFSFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACRAGGCTSLLRVAVGSFRXRCNIGAFELLSKTAPIQAVSLIILGPFADYYLNGRWLLNYKFFNXGATFFILLSCSLAVFCNMSQYLCIGRLSATXSFQFLGHMKTVCVLILGWILFDSALTVKNILGMLLAVMGMVVYSWAVETEKKASAPIPRNKSDMLDDSEDVPLKARVSGLPSSDLEEGEMKS

SEQ ID NO: 4402 - protein, 99 aa, Zea mays
MPAANDFGSEVIPGATEIGLRVQAYLYDGYWEDIGTIEAFYNANLGITKKPVPDFSFYDRSAPIYTQPRYLPPSKVLDADVTDSVIGEGCVIKVRKPFH

SEQ ID NO: 4403 - protein, 153 aa, Prochlorococcus marinus subsp. marinus str. CCMP1375
MGQWLEHTVFSEITAPVEQVWQVWSDLEAMPLWMTWIESVKTIENETTTLPDLTEWTLAANGFRFKWQAKINERIDKQKLEWSSIGGLPTKGSVRFYEEKENFTIVKLIISYELPKALARFMKEDILGKLVTNELQNNLDNFKELVESGHGKL

SEQ ID NO: 4404 - protein, 374 aa, Triticum aestivum
MARSAMSGLVLLLLCATCRLAIGITDGLLSNGNFERGPQPSQLRGTQVMGASSIPSWRTSGFVEYIPSGRKQGDMVLVVPEGAYAVRLGNEASIAQRLRGAVPGARYSLTFSAARTCAQAERLNVSASGQSGVLVMQTMYSSNGCDSYSWAWDANADEVEVVVHNPGVTEDPACGPLIDSVDIKTLTPPRRTNKNLVKNGDFEEGPYIISGTKWGVLIPSRMVDEHSPLPGWMVESLKAVKYIDSDHFAVPRGRRTVELLAGRESAIAQVIRTVPGKQYALSFSVGDASNTCRGSLMVEAYAGRESTKVPYESAGQGGAAKRAVLPFRATSSRTRVVFFSSFYNTRTDDMSSLCGPVIDDVAVVSVRARPPKRA

SEQ ID NO: 4405 - protein, 487 aa, Streptomyces coelicolor A3(2)
MPENNQKPLTTVAGAPVPDNQNSLTSGPRGPMLLQDVWFLEKLAHFDREVIPERRMHAKGSGAFGTFTVTHDITRYTSAKIFSEIGKKTPLFTRFSTVAGERGAADAERDIRGFAVKFYTDEGNWDLVGNNTPVFFFRDPLKFPDLNHAVKRDPRTNLRNAENNWDFWTNLPEALHQVTIVMSDRGIPASYRHMHGFGSHTYSLINAEGERFWVKFHHRTQQGIKNLTDAEAEALVGKDRESHQRDLFDAIEDGDFPKWKLFIQVMPEADAENYRFHPFDLTKVWSKKDYPLIEVGEWELNRNPDNYFADVEQAAFSPANVVPGISFSPDRMLQGRLFSYGDAQRYRLGVNHHQIPVNAPKNPVNSYHRDGAMRVDGNQGATPGVEPNSYGRWQEQPAYRDPAQAVGAVADRFNYREDDDNYFEQPGNLFRQMSPEQQQVLFENTARAIDGASAQTIERHIGNCTQADPAYGAGVRKAIEALAAGNL

SEQ ID NO: 4406 - protein, 250 aa, Triticum aestivum
  unsure (1)..(250): unsure at all Xaa locations
MGRSPCCEKEHTNKGAWTKEEDQRLVAYIRANGEGCWRSLPKAAGLLRCGKXSCRLRWMNYLRADLKRGNFTDDXDELIIRLHSLLGNKWSLIAGQLPGRTDNEIKNYWNTHIKRKLLSRGMDPHTHRPLTPVDGGAAASRPAHIAVPARAAPPTMFAPLPTKQPPVESSSADGSSGATSTGEPRCPDLNLDLSVGPPAADTPTSHPVCLCRHLGLRGGAACSCRQADSPGSQXGGGFRYFRPLEEGQYI

SEQ ID NO: 4407 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFEVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 4408 - protein, 354 aa, Candida glabrata
MSDWKVDPDNRRRLLQLQKIGANKKCVDCGAPNPQWASPKFGIFICLECAGTHRSLGVHISFVRSITMDQFKQEELVRMEEGGNEPFTEYMTAHGIDMTLPHKFKYENPIAEDYKEKLTCKVEGREFVEPQHPDFDPKSLGKSEPVSEPSIASEQSSRQNTPIESRRIGSPTRKEKNEEYFAQLGKKNDSKPDHLPPSQGGKYQGFGNTPVNNRNATDPSTNTMSLENLQTDPLGTLTKGWGLFSSAVAKSFDDVNETYIKPNVQQWNTGELSEETKRAAAQFGQKFQETSTYGMQAFSSFTKNIQKQYINGDESYSQLPASQKNQSASTSRDDLLGDTKKSVPKAGEDEWEEF

SEQ ID NO: 4409 - protein, 216 aa, Ranunculus ficaria
IENTTNRQVTFCKRRNGLLKKAYELSVLCEAEVALIVFSNRGRLYEYSNNSVKKTIERYKKHSTDSSNTGSVSEANAQFYQQEANKLRNQIATLQNSNKNLLGESLSNLSVRELKAIEKKIEGGIAKIRSKKNELLFAEIEYMQKREIDLQNDNMFLRAKIAENERTQQQHMSLMPVNDYEVISSAPYDSRNFLPVNLLDSNHNYSRNDQTTLQLG

SEQ ID NO: 4410 - protein, 86 aa, Glycine max
LAQTLKRSVGWISPSALLLVHSENMTGILYETGEHSGHAVVIKYAPYGGDSRMGMDEYSAEIFMRGKHTLVLLNSLQDTLGAAPII

SEQ ID NO: 4411 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 4412 - protein, 366 aa, Glycine max
CYSSQSQLSHAVFSFTDGLLPNGNFEQGPKPSQLKGSVVTGHDAIPNWTISGFVEYIKSGQKQGDMLLVVPEGDYAVRLGNEASIKQKLKLIKGSFYSITFSAARTCAQEEKLNVSVVPTTEKRDWGIIPIQTMYGSNGWESFTCGFRADFPEAQIVIHNPGKEEDPACGPLIDSVALKVLYPPKRTRANLLKNGNFEEGPYIFPNSSWGALIPPHIEDSHGPLPGWIVESLKAVKYIDSDHFAVPEGKRAIELVAGKESALAQVVITTIGKTYDLTFAVGDANNACESSMMVEAFAGTNTVQVPYQSKGKGGFVRGKLRFKAVSTRTRLRFLSTFYTMKSDNSGSLCGPVIDDVKLLGVRYPTLA

SEQ ID NO: 4413 - protein, 496 aa, Neurospora crassa
MSGLATKQQSLKLFEKLKAKPANKICFDCGQKNPTWTSVPFGIYLCLDCSANHRNLGVHISFVRSTNLDQWQWDQLRIMKVGGNESATKFFQQNGGSAALNSKDPKTKYQSAAATKYKEELKKRAARDAREYPEEVVITDGDDATSSNTPAGEPDDDFFSSWDKPAIKKPTPPISRTSTPPVIGRTASPLLGNGKDIQRTSSPLSKTDSDAPTPAPAASRITTSAALRKTTPGSSTTGGPRKVGGGILGAKKPAAKLGVKKISADLIDFDEAEKKAKEEAERIEKLGYDPEAEEEKAAKKAETKTNNIITPAAAPVSSSSSRSAAQEKSAAEVERLGMGVRKLGFGMVGKPGGAGAAAGAGGAAAAKKNAGGFGSVGPIKASEADEEQYARNKFANQKAISSDEFFNKGNYDPSVKAETKARLQGFEGAQAISSNAYFGRPEDDAPAEDYGDLESAAKDFIRKFGITASDDLENLTQMVGEGAGRLQGAIRAYLGS

SEQ ID NO: 4414 - protein, 484 aa, Oryza sativa
MGQGTPGGMGKQGGLPGDRKPGDGGAGDKKDRKFEPPAAPSRVGRKQRKQKGPEAAARLPAVAPLSKCRLRLLKLERVKDYLLMEEEFVVSQERLRPSEDKTEEDRSKVDDLRGTPMSVGSLEEIIDESHAIVSSSVGPEYYVGILSFVDKDQLEPGCAILMHNKWDWKHHTNTSVVHGLVIGSKRQSDQMVHIRYLQMVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 4415 - protein, 216 aa, Ralstonia metallidurans
MNPQTPPTSPVARKSPDELVVGFVSISDRASSGTYQDEGIPALRDWFGKTLTTPWQSVERLIPDEQAQISRTLIELVDVAGCDLVLTTGGTGPARRDVTPEATLAVGTKEMPGFGEQMRQVSLHFVPTAILSRQVAVIRETPSRAALIVNLPGQPRAIRETLEGLRDADGKSIVQGVFAAMPYCIDLIGGPYIETDEAVVKAWRPKNAVRAKPASA

SEQ ID NO: 4416 - protein, 473 aa, GIBBERELLA ZEAE PH-1
MKAALLNVLTALTLAGYSNATPATTLDKRYSLEDNGIKYKVFEHAATKSQTKIVSNSGICETTPGVNQHSGYFSVGDNMNMWFWFFESRKNAKTAPLALWLNGGPGCSSMIGLFQENGPCTFNKGGSKPTLNPYSWNTFANMLYVDQPIGTGFSYGTDDAVSTLAAAPRVWNLLQAFYAQFPEYENRDFGLFTESYGGHYGPEFAYYFEQQNAAIDAGTIKGEKINLVALGINNGWIDPANQYRDYIEYAANNTYKKLISSTQYSKYLNTYNQKCVPAFAKCPGLTGNDAACGNADDACSQAIERPLENSADFDVYDIRAPSNDPFPPSTYSTYLQSSSVMKAIGAQSTYGECPEAAYDKFINSGDRGRSFLSTLSKVIDSKIQVLIWAGDADWICNWMGNYRALNSIAPQSFVSAPLQSFTVDGTKYGEFKTSGNLSWLRVYGAGHEVPAYQPQAALAAFVATLSKKPISST

SEQ ID NO: 4417 - protein, 369 aa, Triticum aestivum
MFMNCNFNSNLLENEAGRISFPWARPCDGCHAAPSAVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWRLRRNSDDNNCANKIDRYYNLVGYNMYYNNITCDPRPEEQYRMQEQRVQNRYIEKQGCECVVPPQVVMASEQQESDYGTRGAGQAASVTAITSTYTASISNDISFSSMEVGIIPDNTRPDISNSNILTGSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 4418 - protein, 355 aa, Desulfovibrio desulfuricans G20
MRGLLAFGRDPPYSRRSTFPTQEPAVPQSRSAAAAPFALFIAVTLWGSSFVATKIGLRQLEPLSIVWLRQLVATLAILPFWLPAWLRHRHAATVRRSDTGLLLLLAFFQPCLYFVCESYALQLTTASQAGVVSAMMPLMVAVVAGAMLGEQVTRRMWGGFALSVTGVVWLTLASAPEESAPSPMLGNMLELAAMACGVGYTIACRKLGSTFSPVIITGVQILAGFLFFLPGAFMLPAGFTSMAAQALTTPGSDAAISLFAVGYLGLFVTLGAFALYNFGVSALSASKASAWINLVPVVSIVLGHLVLGETFSPYQAGGALLVLGGLYLCQRTPAPPRHGIMQVQKPQRAGALEKE

SEQ ID NO: 4419 - protein, 546 aa, Zea mays
PRVRFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSHDGEFPQQEIIGVFNKNCMISYSQYRNIFPIWALGEYRCRVLGAGKSWR

SEQ ID NO: 4420 - protein, 342 aa, Agrobacterium tumefaciens str. C58
MTKTMKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDLAA

SEQ ID NO: 4421 - protein, 506 aa, Pseudomonas putida KT2440
MRYAHPGTEGAKVSFKSRYGNYIGGEFVTPVKGQYFENTSPVNGKLIAEFPRSTAEDIDKALDAAHAAADAWGRTSVQDRSNVLLKIADRIEQNLELLAITETWDNGKPIRETLNADIPLAVDHFRYFAGCIRAQEGGAAEINEGTVAYHIHEPLGVVGQIIPWNFPILMAAWKLAPALAAGNCVVLKPAEQTPLGITVLLEVIGDLLPPGVLNVVQGYGREAGEALATSKRIAKIAFTGSTPVGSHIMKCAAENIIPSTVELGGKSPNVYFEDIMQAEPSFIEKAAEGMVLAFFNQGEVCTCPSRALVQESIYPQFMEVVMKKVLQIKRGDPLDTDTMVGAQASQQQFEKILSYLQIAQEEGAELLTGGKVEKLEGSLATGYYIQPTLLKGNNKMRVFQEEIFGPVVSVTTFKDEAEALAIANDTEFGLGAGVWTRDINRAYRMGRGIKAGRVWTNCYHLYPAHAAFGGYKKSGVGRETHKMMLDHYQQTKNLLVSYDINPLGFF

SEQ ID NO: 4422 - protein, 138 aa, Mycobacterium avium
MVLMRTDPFRDLDRWTQQVLGTRRPAVMPMDAWRDGDQFVVEFDLPGVNADSLDLDVERNVLTVRAERPDLDQNREMVSAERPRGVFSRQLFLGDNLDTDKIEANYHDGVLRLTIPVAEKAKPRRIEINHNHRTAINA

SEQ ID NO: 4423 - protein, 950 aa, Bacteroides thetaiotaomicron VPI-5482
MKWILAVGLLSCSVAMAQQQSDILSVSASANAENAALAFDRNVKTMWTIPSQALKAEQWLMFTIQQPGDVCELDLQMQGINKNELKEVLDIFVTYDPMNLGTPVNYRIEGSDKQMKVKFTPKYGAHVKLNFKSGKLDKPFSLKEISVLVAEKVLTDSQGKVTDRRYMDASLPVEERVESLLAVMTPEDKMELIREGWGIPGIPHLYVPPITKVEAVHGFSYGSGATIFPQALAMGATWNRKLTEEVAMVIGDETVAANTKQAWSPVLDVAQDARWGRCEETFGEDPVLVSQIGGAWIKGYQSRGLFTTPKHFGGHGAPLGGRDSHDIGLSEREMREIHLVPFRHAIRNYDCQSLMMAYSDYMGVPVAKSKELLQQILRQEWGFNGFIVSDCGAIGNLTARKHYTAKDKIEAANQALAAGIATNCGDTYNNKEVIQAAKDGRINMEDLDNVCRTMLGTMFRNELFEKNPCKPLDWKKIYPGWNSDSHKEMARQAARESIVMLENKDNLLPLSKTLRTIAVLGPGADDLQPGDYTPKLLPGQLKSVLTGIKGAVGKQTKVLYEQGCDFTNPDETNIPKAVKAASQSDVVIMVLGDCSTSEATNDVRKTCGENNDWATLILPGKQQELLEAVCATGKPVILILQAGRPYDILKASEMCKAILVNWLPGQEGGPAMADVLFGDYNPAGRLPMTFPRHVGQLPLYYNFKTSGRRYEYVDMEYYPLYRFGFGLSYTSFEYSNLKIQEKANGNVEVQATVKNVGSRAGDEVAQLYVTDMYASVKTRVMELKDFARIHLQPGESKTVSFEMTPYDISLLNDRMDRVVEKGEFKIMVGGMSPDYVAKNEIKHSVGYSDNKKGVTGMLNYTHEFGANFDLAVSKVEENLVKNQKTVWVSVKNTGTLMDIGKVEMFVDGKKVGDAVHYELGAGEEKLIPFKLAKENKQPVAFTTKYKMVSM

SEQ ID NO: 4424 - protein, 469 aa, Methanosarcina barkeri
MVKKMERLKKLSIVTFILLIALVSPALAATSDQNAASIEEIKTTLTFMWLLLASGLVFFMHAGFSLVETGLTRSKNTANILMKNFMTVVLGILVYWAVGWGIMYGADAAGLIGTNQFFLAGADNATWNSWFFQMVFAATGATIVSGAMAERTNFKAYLVYCIMMVAVIYPIYGHWVWSGADMALLSGADSPIVKAIGVASHDFAGSGVVHSIGGYSALAGVILVGARIGRFKNGKPIPIPGHNLTITFLGTLILALGWLGFNGGSTLNANDPYMNLVVVNTFLAAAAGALMVMIITWVKTGKPDPSLTANGLLGGLVAVTAPCGSISNWAALVIGLVAGIIIYVGVMFNENKLKLDDPVGAIAVHGYCGSWGLISVGLFSIGMGNGILADATYAAAVPGLFYGGGISLLLIQLVSVLVTMVWGFGISYIIFKILDAVIGLRVSEEEEIMGLDISEHGIRAYPEYLMREE

SEQ ID NO: 4425 - protein, 971 aa, Spinacia oleracea
MATLPLSSTTPSTGRTENCFSSYYSSSISRVMEFGLKNGCNSKLLFSSVNYKPMIMRGSRRCIVIRNVFSESKPKSEEPIIEQETPSILNPLSNLSPDSASRQSSIKYHAEFTPLFAPNDFSLPKAFFAAAQSVRDSLIINWNATYAHYEKMNMKQAYYLSMEFLQGRALLNAIGNLELTDAYGDALKKLGHNLEAVACQERDAALGNGGLGRLASCFLDSLATLNYPAWGYGLRYKYGLFKQMITKDGQEEVAENWLEIANPWELVRNDVSYSIKFYGKVVSGSDGRSHWTGGEDIRAVAYDVPIPGYQTKTTINLRLWCTTVSSEDFDLSAFNAGEHAKANEARANAEKICSVLYPGDESMEGKILRLKQQYTLCSASLQDIISQFERRSGEHVNWEEFPEKVAVQMNDTHPTLCIPELMRILIDVKGLAWKEAWNITQRTVAYTNHTVLPEALEKWSFELMQSLLPRHVEIIEKIDEELVDTIVSEYGTDDPKLLMGKLNELRILENFHLPSSVASIIKDKITCQVDEDKKIEISDEVDGLVVVEESEEGDIEKQAVEEPVPKPAKLVRMANLCIVGGHAVNGVAEIHSQIVKEQVFRDFFELWPEKFQNKTNGVTPRRWIRFCNPELSSILTKWIGSDDWVLNTEKLAELRKFADNKDLHTEWMEAKRNNKQKVVSLIKERTGYTVSPDAMFDIQIKRIHEYKRQLMNILGIVYRYKKMKEMSAAERKEKYVPRVCIFGGKAFATYVQAKRIVKFITDVGATINHDPEIGDLLKVVFIPDYNVSVAELLIPASELSQHISTAGMEASGTSNMKFSMNGCILIGTLDGANVEIREEVGEDNFFLFGARAHDIAGLRKERAEGKYVPDPCFEEVKEYVRSGVFGSNSYDELLGSLEGNEGFGRADYFLVGKDFPSYVECQEQVDQAYRDQQKWTRMSILNTAGSFKFSSDRTIHQYAKDIWNIHPVNLP

SEQ ID NO: 4426 - protein, 200 aa, Glycine max
MAEQALEGSQPVDLTKHPSGIVPTLQNIVSTVNLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHSAFSSYEPELFPGLIYRMKQPKIVLLIFVSGKIVLTGAKVRDETYTAFENIYPVLTEFRKNQQ

SEQ ID NO: 4427 - protein, 243 aa, Zea mays
MFGYRKAGPDLEAGGSSLLYPGMTESPELRWAFVRKIYVILAVQLAMTAAVSAFVVKVPAVSNFFVSSNAGVALYIFLIILPFLVLCPLRYYHQKHPVNLLLLGLFTVAISFAVGMTCAFTSGKIILEAAILTAVVVISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 4428 - protein, 739 aa, Gluconacetobacter xylinus
MMMSRKLMLLSAVAFGGIVALSPGAQAREGQDAPATTADSRARDLLSHMTLQDKLSMVFTIDGGGTMGNAPIPPGGLGSAAYLKTPAGLPPLQISDAGLGLRNPSHVRPHGQAVGLPSGLATASTWDPDMARQGGAMIGAEAWRQGFNVLLAGGADLTRDPRGGRNFEYAGEDPLLTGRVVGATIAGIQSQHVISTLKHFAMNDLETSRMTMSADIDTAAMRESDLLGFEIAMEVGHPGSVMCSYNRVNDIYACENPYLLTKVLKQDWKYPGFVMSDWGATHSSARSALAGLDQESSGDDADARPFFREILARDVREGRVPTSRVDDMAQRIVRSMYDVGLVDHPPVMQPLDVVTDILTAQRDEEEGAVLLKNSGNLLPLSPTAHVAVIGGHADVGVISGGGSSQVDPIGAPAIGVVKGPGKKDWPGDPVYFPSSPYRMMQAEAPSARLTYTSGADIARAADAARRADVAVVFVTQFSYEGMDTANAMTLDGNQDALVAAVARANPRTVVVMETGNPVMMPWLDNVGAVMEAWYPGSGGGAAIARLLYGKVAPSGRLPMTFPASPVQLAHPDIAGVTANSVFEMQFHTDQELVYDEGSEVGYRWFDHTHATPLFAFGHGLTYTTFAHDGLRVAHHGDDVVATFTVRNMGTRVGVDVPQLYVRLPDGGGRRLAGWQRVTLAPGESRELSVVLEPRVLAHFDEKHDRWNVPSGEYRIWLGSSAVDESQQVTFHLAGRNMAP

SEQ ID NO: 4429 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPTDGAAHQCESLRSSSRKLRSDQVAAPAHRSQPTTGLTMVLHASSIELSHYFQFLLKFVLLAYAVLCLTELLHRWSNGSVLSLWSA

SEQ ID NO: 4430 - protein, 87 aa, Oryza sativa
TRTHTRTRTFRFAPSLTFRPLVVDALGPDTDLPADVHLMIVEPAQQAPDFINAGADIDSVDCQQSFTIHLHRTVNNIKSLGTQAGVG

SEQ ID NO: 4431 - protein, 508 aa, Arabidopsis thaliana
MPSVGIVIGDGKKEYPGKLTLYVTVTCIVAAMGGLIFGYDIGISGGVTTMDSFQQKFFPSVYEKQKKDHDSNQYCRFDSVSLTLFTSSLYLAALCSSLVASYVTRQFGRKISMLLGGVLFCAGALLNGFATAVWMLIVGRLLLGFGIGFTNQSVPLYLSEMAPYKYRGALNIGFQLSITIGILVANVLNFFFSKISWGWRLSLGGAVVPALIITVGSLILPDTPNSMIERGQFRLAEAKLRKIRGVDDIDDEINDLIIASEASKLVEHPWRNLLQRKYRPHLTMAILIPAFQQLTGINVIMFYAPVLFQTIGFGSDAALISAVVTGLVNVGATVVSIYGVDKWGRRFLFLEGGFQMLISQVAVAAAIGAKFGVDGTPGVLPKWYAIVVVLFICIYVAAFAWSWGPLGWLVPSEIFPLEIRSAAQSITVSVNMIFTFLIAQVFLMMLCHLKFGLFIFFAFFVVVMSIFVYLFLPETRGVPIEEMNRVWRSHWYWSKFVDAEKNLTKVVI

SEQ ID NO: 4432 - protein, 188 aa, Triticum aestivum
MASSTALSPVAFKSSFSPLPSRPARTRINVQGAFCLPCSTWKRANNRSFRVYSLFGGKKEKDENGDEAPSKGGIFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGDGLK

SEQ ID NO: 4433 - protein, 352 aa, Nostoc sp. PCC 7120
MAGCPADAIVDFSASISPLGPPQNAIAAIQSQISNLRHYPDPDYRELRLALSHFHQLPLEWILPGNGSAELLTLAGRELAQLAATILITPAFGDYYRTLRAYHAKVLEFPLVSAESRILGTECHLTQLHTQHSGLITNYALLLNNPHNPTGKLFTREAILPLLEQFALVVVDEAFMDFVPPDEEQSLIPVVAEYPNLVILRSLTKFYSLPGLRLGYAIAHPDRLQKWQLWRDPWPVNTLAAAAAIAALEDREFQAQTWQWLPPAREELFQGLTAIPGLIPQASAANFLLVETQQSSLDLQQKLLQQHQILIRDCLSFKELGDRFFRVAVRSHTDNQRLTKALSAIVQNSFDH

SEQ ID NO: 4434 - protein, 476 aa, Yersinia pestis CO92
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENADEDSARFYRSEGGGGVSDSGYAGKVRGKIEPLGFLFVRLDLLIRLSLLIRLNLFIRMNLLIILTLFFKLASIQASH

SEQ ID NO: 4435 - protein, 386 aa, Solanum tuberosum
ADNQHPTVYQKVASQMHLSSSLSQDVHARYGGIQRPALSQRRFPYGNYSNAGLQTCQATQDLSLIAANASPVFVQAPQEKGLAAFATDFLMGGVSAAVSKTAAAPIERVKLLIQNQDEMIKAGRLSEPYKGIGDCFSRTIKDEGFAALWRGNTANVIRYFPTQALNFAFKDYFKRLFNFKKDRDGYWKWFAGNLASGGGAGASSLLFVYSLDYARTRLANDAKAAKKGGGGRQFDGLVDVYRKTLKSDGVAGLYRGFNISCVGIIVYRGLYFGMYDSLKPVLLTGKMEDSFFASFALGWLITNGAGLASYPIDTVRRRMMMTSGEAVKYKSSFDAFNQILKNEGPKSLFKGAGANVLRAVAGAGVLAGYDKLQVIVFGKKYGSGGG

SEQ ID NO: 4436 - protein, 488 aa, Guillardia theta
MSQSVESRTRIKNERYESGVIPYAKMGYWDADYVIKDTDVLAMFRMTPQKGVDPVECAAAIAGESSTATWTVVWTDLLTACDLYRAKAYRVDPVPGATDQYFAYIAYELDLFEEGSLANLTASIIGNVFGFKAVNALRLEDMRLPIAYLKTFQGPATGVIVERERLDKYGRPLLGATVKPKLGLSGKNYGRVVYEGLKGGLDFLKDDENINSQPFMRWKERFLFGIEGVNRAAAAAGEVKGHYFNVTAGTMEDMYERAEFCKEIGSVICMIDLVIGYTAIQSMAIWARKNSMILHLHRAGNSTYSRQKTHGMNFRVICKWMRMAGVDHIHAGTVVGKLEGDPLMVKGFYNTLLETQTDVNLVQGLFFAQDWAALNKCMPVASGGIHCGQMHQLINYLGDDVVLQFGGGTIGHPDGIQAGATANRVALECMVVARNEGRDYVTEGPQILRNAAKSCGPLQTALDLWKDITFNYASTDTADFVETATANK

SEQ ID NO: 4437 - protein, 819 aa, Haemophilus somnus 129PT
MVNTLPLPFSYNRPENTKDSLKKSIVYKLIFLIGRSPEEASQRDWLNATLYAIRDLVTEGWISTARQARKEETRRVYYLSMEFLMGRTLSNALISEGVYHLAKDALAELNVDLEDVLEKEVDPGLGNGGLGRLAACFMDSIATLAIPGMGYGIRYEYGMFQQYIEDGKQVEKPDAWLEKGYPWEFIRPSKRFNIRFGGHIYFEGKKCIWKNAEEITALAYDQMIPGYSNDSAATLRLWSANAGETFNLVSFNRGDYFHAIEEKSSSENVSRVLYPDDSTSAGRELRLRQEYFLVSASLQDIIKRHKRIYNTLDNLADKIAIHLNDTHPALAIPELMYILIDQEGYTWQKAWDMCCQIFSYTCHTLMSEALETWPVEMMAKILPRHLQIIFEINDYFLEYVRTSVTTDNDFIRRISLIEEGNIRKVRMGWLSVVGSHKVNGVAAIHSDLMVSSTFADFYRIYPERFTNVTNGITPRRWIAVANPDLSALFDKYIGTEWRKDLTQLETLKAHIQDPELKKAIREIKRKNKQRLANYVKQELGIELNSNALFDVQVKRIHEYKRQILNVLHIVARYNEMIANPEKDWTPRVFILAGKAASAYTAAKQTINLINDVANIINNDDRLQGRLKVVFIPNYSVSLAQIIIPAADISEQISLAGTEASGTSNMKFALNGALTLGTLDGANVEILENVGKDNIFIFGNTVEQVEELRRNGYHPFDIYQSDEQLREVIDQINAGRFSPKEPTRYHDLLNSLRSYDYYQSFADFRSYVEMQKVVDEKYKNQEAWVESALQNIVNMSFFSSDRTILEYAEKIWKIEPLKLA

SEQ ID NO: 4438 - protein, 137 aa, Oryza sativa (japonica cultivar-group)
MATCRSRGVERGGAPHVLAVDDSSVDRAVISGILRSSQFRVTAVDSGKRALELLGSEPNVSMIITDYWMPEMTGYELLKKVKESSRLKEIPVVIMSSENVSTRINRCLEEGAEDFLLKPVQPSDVSRLCSRVLRCCG

SEQ ID NO: 4439 - protein, 198 aa, Streptococcus mitis
GIEDILVVTGKSKRSIEDHFDSNFELEYNLKEKGKHDLLKLVDETTGIRLHFIRQSHPRGLGDAVLQAKAFVGNEPFVVMLGDDLMDITDDHAVPLTKQLMNDYETTHASTIAVMPVPHEDVSAYGVIAPQGEGINGLYSVETFVEKPAPEDAPSDLAIIGRYLLTPEIFDILENQAPGAGNEIQLTDAIDTLNKTQR

SEQ ID NO: 4440 - protein, 498 aa, Eremothecium gossypii
MKREDSTEEEIRPRSVGPPLKQRNARSSSNMHLVADEEESTPSYMPPWTTPYIIGVGGTSGSGKTSVASKIVASINTPWTVLISLDNFYKPLSAEERARAFRNEYDFDEPQALDLDLAYQCLLALKEGKKMTMPVYSFVHHNRVPDKSITIYGASVVVLEGIYALHDKRITDLMDLKVYVDADLDICLARRLSRDIISRGRNLESCISQWEKFVKPNADKFVKPTMKNADAIFPSMSDNSIATKMLINHIKSKLQRKSQDHIDKLVQLGHETIPLETLDTIHQLERTNQACSLKTMILDSSLDRDDFVFYFNRIATILVSRALDDIAIVRDELPLVTASGYQLEKPVHVNFDKITAVNIVRSGDCFMASLRKTVPNISIGKLLIQSDSQTGEPQLHCEFLPVNIGGSFDQVLLMDAQIISGAAIIMAIQVLVDHGVELSKIKVIVYLATEIGIRRIINAFNNKVVIYAGEIISDESMTDGQCNWARLRFIDSRYFGCD

SEQ ID NO: 4441 - protein, 246 aa, Tsuga canadensis
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTAISSSDKKKEEALEVLHADAYLVSKDAEKMQEAAESLDYILDTIPVAHPLEPYLSLLKTNGK

SEQ ID NO: 4442 - protein, 315 aa, Betula pendula
MENFPVINMEKLNGDERGATMAKINDACENWGFFELVNHSIPHEFLDNLERLAKEHYKKCLEQRFKEMVASKALEGAKAEVNDMDWESTFHVRHLPQSNISEIPDLEDEYRNVLKEFALKLEKLAEELLDLLCENLGLEKGYLKNAFYGSNGPTFGTKVSNYPPCPKPDLIKGLRAHTDAGGIILLFQDDKVSGLQLLKDGQWIDVPPMRHSIVINLGDQLEVITNGKYKSILHRVIAQTDGNRMSIASFYNPGSDAVIYPAPSMVEKETEEKNVYPKFVFEDYMKLYAGLKFQAKEPRFEAMKANGKLGPIATA

SEQ ID NO: 4443 - protein, 265 aa, Glycine max
MEVETEKSGSDGKGWSFCRMPFWQTTHTPSSSTTSMSYMHNVHPQNQNNFQSVDRSSHHSSTTVSSMAKSLLPTKRRLHLDPSNKLYFPYEPGKQVRSAIAIKNTCKSHVAFKFQTTAPKSCYMRPPAGILAPGESIIATVFKFVEPPENNEKPIDQKSKVKFNIMSLKVQGEMDYVPELFDEQRDQVAIEQILRVIFLDPEKPSPVLDKLKRMLAEADAALEARKKPLEEKGPCVAGEGLVIDEWKERRERYLAQQQVQGVDSV

SEQ ID NO: 4444 - protein, 376 aa, Nicotiana tabacum
GLGTTMGCTGPKSVIEVRNGLTFLDLIVKQIEALNAKYGCTVPLLLMNSFNTHDDTLKIVEKYANSNIEIHTFNQSQYPRLVTEDFSPLPCKGNSGKDGWYPPGHGDVFPALANSGKLDALLAKGKEYVFVANSDNLGAIVDLKILNHLIQNKNEYCMEVTPKTLADVKGGTLISYQGKVQLLEIAQVPDEHVNEFKSIEKFKIFNTNNLWVNLNAIKRLVEADALKMEIIPNPKEVDGVKVLQLETAAGAAIKFFDRAIGVNVPRSRFLPVKATSDLLLVQSDLYTLTDEGYVIRNPARSNPSNPAIELGPEFKKVANFLGRFKSIPSIIDLDSLKVTGDVWFGSGVTLKGKVTVAAKSGVKLEIPDGAVIANKD

SEQ ID NO: 4445 - protein, 393 aa, Zea mays
  unsure (1)..(393): unsure at all Xaa locations
MALRLHDVALCLSPPLAARRRSGGSFVAVASMTSAAVSTRVXENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMRKKISMPAHLMFDGQDDKLFEHFSMVAQRLGVYTARDYADILEFLVDRWKVANLTGLSGEGNKAQDYLCTLASRIRRLEERAQSRAKKAGTLPFSWVYGRDVQL

SEQ ID NO: 4446 - protein, 447 aa, Staphylococcus xylosus
PLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVKTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAHG

SEQ ID NO: 4447 - protein, 132 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 4448 - protein, 146 aa, Glycine max
GPIPSYQRWGQIVLWFQSIPDGVSLPRVGHTATLVLGGRLLVYGGEDSYRQRKDDFWVLDISAIPYPCITQQITVSSKKVLTRMWKRWKSSGHAANSRSFHRACADRSGRYVYVFGGMVDGFLQPAEPSGLRFDGELFLVELVLQL

SEQ ID NO: 4449 - protein, 249 aa, Rhodobacter sphaeroides
MGKKMRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 4450 - protein, 392 aa, Sulfolobus tokodaii
MSDELDSYRAKHYNSDDPIVRLLEEKIESLTKELEKLRQDLNWYKGELEKLLAPPYIEAIVLDILPDGKVIVRSSSGPNLIVNVSSNIDIKKLKPGSLVALTQRGSTIVEVLPEREDAYVKSFEVIEKPNVHYSDIGGLNEQINEIREVIELPLKNPELFKEIGIDPPKGVLLYGPPGTGKTLLAKAVATESNATFIQVVASEFAQKFVGEGARIVREVFELARRKAPSIVFIDEIDAIGAKRVDMGTSGEREIQRTLMQLLAEIDGFKPLDNVKIIAATNRLDILDPALLRPGRFDRLIEVPLPNFEGRKEIFRIYLQKMKTDGNIRYDILASMTEGFSGAEIKNVCTEAGYIAIRNGRKYVNMTDLITAIEKIKAKNNKAKNTDRTEKYV

SEQ ID NO: 4451 - protein, 308 aa, ASPERGILLUS NIDULANS FGSC A4
MASTAKLEISHPQQQVVKPVKKVHYPFWFGGSASCFAAAVTHPLDLVKVRLQTRGPGAPSTMLGTFGHILRNNGFFGLYNGLSAALLRQLTYSTTRFGIYEELKSRFTSPSQSPSFFTLLGMACTSGILGGIAGNPADVLNVRMQSDAALPPAQRRNYRHAFHGLVQMTRTEGFSSLFRGVWPNSTRAVLMTSSQLVSYDVFKRLCLEKFGMKDNVVTHFSASFAAGFVATTVCSPVDVIKTRVMSASPSETRGHNIVGLLREISRKEGLAWAFRGWVPSFIRLGPHTIATFIFLEEHKKLYRYLKGI

SEQ ID NO: 4452 - protein, 210 aa, Sporobolus stapfianus
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGAAGSSSQGGGCCS

SEQ ID NO: 4453 - protein, 112 aa, Magnetospirillum magnetotacticum
MLREHGTERAHTSPLNAEKRPGRFVCAGCDLPLFSSRTKFESGTGWPSFFEPLPDAVGTQVDTAYGMRRTEVHCRRCGGHLGHVFEDGPKPTGLRYCMNGVSLRFEPAAGPA

SEQ ID NO: 4454 - protein, 447 aa, Methanosarcina mazei Goe1
MVQMKKCTTKEDVLEAVKERDVKFIRTQFTDTLGIIKSWAIPAEQLEEAFENGVMFDGSSIQGFTRIEESDMKLALDPSTFRILPWRPATGAVARILGDVYLPDGNPFKGDPRYVLKTAIKEAEKMGFSMNVGPELEFFLFKLDANGNPTTELTDQGGYFDFAPLDRAQDVRRDIDYALEHMGFQIEASHHEVAPSQHEIDFRFGDVLCTADNVVTFKYVVKSIAYHKGYYASFMPKPLFGVNGSGMHSNQSLFKDGKNVFYDPDTPTKLSQDAMYYIGGLLKHIREFTAVTNPVVNSYKRLVPGYEAPVYISWSAQNRSSLIRIPATRGNGTRIELRCPDPACNPYLAFALMLRAGLEGIKNKIDPGEPTNVNIFHLSDKEREERGIRSLPADLKEAIDEMKGSKFVKEALGEHVFSHYLCAKEMEWDEYKAVVHPWELSRYLSML

SEQ ID NO: 4455 - protein, 367 aa, Zea mays
GHIRSHRRGRRCRDLYCHGCRGHWEAVHLRLAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKS

SEQ ID NO: 4456 - protein, 305 aa, Arabidopsis thaliana
MEARIILLRIQIPWSANRQFSHPPLDFPRFIRASSSSTSQKPKTYEGPKPRKNLVADFISKNDDLVRSLPIYVGGASLLAVLFNRTVSGIAPVADASSSQSRADLLALGLAVTNLLTGLVWLSIRPKSITPVNPKGVECKVVESDLPASMVSELLWAWESLKVATCCKSLVIVYNGICLIQIGMVAESPEDKKTVIVKTDKLMQGSVYRGVMKSKARKNNDCLSESYLANLSLYPGRSELPFLPANTQAVILQPLGDKGIAVIGGNTIRGFTSSDQAWISSIGEKLDATLGRYFVDSDEISRVTV

SEQ ID NO: 4457 - protein, 457 aa, Zea mays
MQPNRLREVRLAASPTTTRARVPPPAALGMAGPKAAEDGSAAPLLPAQAGERSSGGVGGGATSAQTLGNVVVSIVGTGVLGLPYAFRAAGWVAGSIGVAAAGSATLYCMLLLVDCRDKLKEEETEECCHGHYTYGDLGDRCFGTIGRCLTETLVLVSQAGGSVAYLIFIGQNLHSTFSQLMSPAGFIFAILLPLQIALSFIRSLSSLSPFSIFADVCNVLAMAIVIKEDLQLFDHPFSNRSAFNGLWAVPFTFGVAVFCFEGFSMTLALEASMADRRKFRSVLSQAVAAIIAVYVCFGVCGYLAYGEATKDIITLNLPNNWSSAAVKVGLCIALAFTFPVMMHPIHEIVETRFRSNRCFRKLSHNDGGAEWIGLHASRVLVVAVLTVVASFIPFFGSFISFVGSTMCALLSFVLPALFHLSIVGSSIPLWRRVLDYGILLFGLAFAGYGLVTALSSH

SEQ ID NO: 4458 - protein, 210 aa, Triticum aestivum
  unsure (1)..(210): unsure at all Xaa locations
MTTLLDALRQTTQVDCDTLDANVAHQLGPFVDCTSNQAIAFSEISRPLAGEPLLHYDALVKDAIEKARGALKEFQGSATFEEFVVQILMVKLQLLIVPNVTGYVHIQTNPKLSYSTDGTMSDAHRIVNIFKALAPEFDTKRVCIKIPATWEGLQACRALEVEGIATLATTMFCMEQATLAADAQCTYIAPYVNELKVHFEAGYVDEHXAF

SEQ ID NO: 4459 - protein, 379 aa, Sorghum bicolor
MEPVFSMEEILGPFWDLPSPPPPEQQPLVIGTSSVVIDGVVTHGGNGEGSNMMDQIQNTTEDPFERLLEEELLTDTTPVANSSCPALNVDPVVEVDQGAMAPEAVSAVGDPMEYNAILKRNVEEDLMAFKMWRASTSGVNSEGSNNENGGDLHVRLTTSSSSRDPSPSDEDMDGEVEILGFKMPTEERVRKRKESNRESARRSRYRKAAHLKDLEDQVDKLKAENSCLSRRLAALNQKYNHATVDNRVLKADMETLRAKVKMGEDSLKRIIEMTSLTSIPIPELPSSSDVPVHIQDNIVNYFTTTPAGDALADHSFMPMPDPLPLQLQAEEPTINGALNARDEPNRYALRGREPTINAAYPGDNGSHDADLLRINSPGI

SEQ ID NO: 4460 - protein, 962 aa, Arabidopsis thaliana
MDTMRISGVSTGAEVLIQCNSLSSLVSRRCDDGKWRTRMFPARNRDLRPSPTRRSFLSVKSISSEPKAKVTDAVLDSEQEVFISSMNPFAPDAASVASSIKYHAEFTPLFSPEKFELPKAFFATAQSVRDALIMNWNATYEYYNRVNVKQAYYLSMEFLQGRALSNAVGNLGLNSAYGDALKRLGFDLESVASQEPDPALGNGGLGRLASCFLDSMATLNYPAWGYGLRYKYGLFKQRITKDGQEEAAEDWLELSNPWEIVRNDVSYPIKFYGKVVFGSDGKKRWIGGEDIVAVAYDVPIPGYKTKTTINLRLWSTKAPSEDFDLSSYNSGKHTEAAEALFNAEKICFVLYPGDESTEGKALRLKQQYTLCSASLQDIVARFETRSGGNVNWEEFPEKVAVQMNDTHPTLCIPELMRILMDLKGLSWEDAWKITQRTVAYTNHTVLPEALEKWSLELMEKLLPRHVEIIEKIDEELVRTIVSEYGTADPDLLEEKLKAMRILENVELPSAFADVIVKPVNKPVTAKDAQNGVKTEQEEEKTAGEEEEDEVIPEPTVEPPKMVRMANLAVVGGHAVNGVAEIHSEIVKQDVFNDFVQLWPEKFQNKTNGVTPRRWIRFCNPYLSDIITNWIGTEDWVLNTEKVAELRKFADNEDLQSEWRAAKKKNKLKVVSLIKERTGYTVSPDAMFDIQIKRIHEYKRQLLNILGIVYRYKKMKEMSASEREKAFVPRVCIFGGKAFATYVQAKRIVKFITDVASTINHDPEIGDLLKVIFVPDYNVSVAELLIPASELSQHISTAGMEASGTSNMKFSMNGCVLIGTLDGANVEIREEVGEENFFLFGAKADQIVNLRKERAEGKFVPDPTFEEVKKFVGSGVFGSNSYDELIGSLEGNEGFGRADYFLVGKDFPSYIECQEKVDEAYRDQKRWTRMSIMNTAGSFKFSSDRTIHEYAKDIWNIKQVELP

SEQ ID NO: 4461 - protein, 658 aa, Zea mays
MRLLLRRRRRFPASETAAATMATAAAASTALTGATTAAPKARRRAHLLATRRALAAPIRCSAASPAMPMAPPATPLRPWGPNEPRKGSDILVESLERCGVRDVFAYPGGASMEIHQALTRSPVIANHLFRHEQGEAFAASGYARSSGRVGVCIATSGPGATNLVSALADALLDSVPIVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVTIAKGFNIPAVRVTKKNEVRAAIKKMLETPGPYLLDIIVPHQEHVLPMIPSGGAFKDMILDGDGRTVY

SEQ ID NO: 4462 - protein, 297 aa, Saccharomyces cerevisiae
MSGPPPPYEEQSSHLYGQPASSQDGNAFIPEDFKYSTVVISCEPIIRQRFMHKVYSLLSCQLLASLSFCYWASVSTSLQNFIMSHIALFYICMVVSLVSCIWLAVSPRPEDYEASVPEPLLTGSSEEPAQEQRRLPWYVLSSYKQKLTLLSIFTLSEAYCLSLVTLAYDKDTVLSALLITTIVVVGVSLTALSERFENVLNSATSIYYWLNWGLWIMIGMGLTALLFGWNTHSSKFNLLYGWLGAILFTAYLFIDTQLIFRKVYPDEEVRCAMMLYLDIVNLFLSILRILANSNDDN

SEQ ID NO: 4463 - protein, 788 aa, Agrobacterium tumefaciens str. C58 (U. Washington)
MEYGPSPEANGDVKQWLDAHGRSFGHYINGRFVSPDGRKTIAVSNPANGDKLAEIVCGNEEDVDQAIKAARAAFGKWSKLSGHARARYLYAIARHIQKRERFLSVLETMDNGKPVRETRDIDIPLVARHFYHHAGWAEMVEDEFHGFSPVGVCGQVIPWNFPLLMLAWKIAPALAAGNTVVLKPADLTPLTAIAFAEICHEVGLPAGVVNIVQGDGSTGAAICGHDGVDKVAFTGSTKVGRVIREQIAGSGKKLSLELGGKSPFIVFEDADLDAAVEGVVDAIWFNQGEVCCAGSRLLVQEGIAEKFYARLKKRLETLRVGDPLDKSTDVGAIVSATQVKRITDLVRKGVEEGGELWQSSNPLPPTGNYVAPGFFTDVDQASTVCQVEIFGPIAAATTFRTPDEAVSLANNTRYGLAASIWSENINVALDLAARVKAGVVWINCTNMLDAGAGFGGYRESGFGREGAREGLYEYLAADWEKNLSVSKPAEAFAPSALPNADSKKAIDGLDRTMKNYIGGKQARPDGGYSYSVTGKGNAVIGMAGIGNRKDIRNAVEAASKAGSWSSATAHNRAQVLYYLAENLNARRDEFVARIIDSTGVSEKKARDEFDASLRRISYYAAQADKFDGAIHSTKSRHVTLAMNEPWGIVGIVCPDEAPLLSLVSLVLPAIAMGNRVVVIPSSRHPLIAGDFYQVLDTSDVPGGVINIVTGERDMLAKTLAEHDDVAAIWYFGSAVGSAMVERASAGNLKAAWVNNGRQPDWLDRTQWQGRDYLRRAIQVKNIWVPYGA

SEQ ID NO: 4464 - protein, 362 aa, Dechloromonas sp. RCB
MSLADQALSYVRAISPYQPGKPITELAREMGIPVEKIVKLASNENPLGMSPKARKAVEAAISGIERYPDQFDLIAKVAERCGVSSNQIVLGNGSNDVLDLIARVFLAPGRSAVFAQHAFAVYPLATLSTGAELISTPAKNYGHDLNAMRAAIRPDTRIVWIANPNNPTGNFLPYPEVRAFLEVVPKDVVVVLDEAYNEYIPPAERVDTATWIKDFPNLVVCRTFSKIFGLAGLRVGYALASTEVADLMNRIRQPFNVNNLAIAAAVAALDDHLFVADSYELNRRGMEQIIAGLKRFGLEHIPSHGNFVTFRAGDAAVVNQKLLKQGVIVRPIGGYGLPEWLRVTIGTEPENARFLEALEKAL

SEQ ID NO: 4465 - protein, 367 aa, Oryza sativa (japonica cultivar-group)
MDYTNAIHIIPDAAGPDAWANAAAQGGDAGIWATEDDYNSQWNADGGGGGSSRAGSEQPPPGKKSRGGGGGEGGGNTSKSRAIGKMFFKTKLCCKFRAGTCPYVTNCNFAHGMEELRKPPPNWQEIVAAHEEATEAREEHQIPIMTSSGPTAGGDAGCGGGGGGGSGRAYKGRHCKKFYTDEGCPYGDACTFLHDEQSKARESVAISLSPSVGGGGGGGSYNSAAAAAASASAAAGNGPMQKPSNWKTRICNKWEMTGYCPFGSKCHFAHGAAELHKYGGGLVDIDSRDAAATPDSKQAVVSAKAPAETAAASTTVLPHADVYHLGVQAQRSTIAGQRSGQVQRPIQKWKGPDKISRIYGDWIDETE

SEQ ID NO: 4466 - protein, 474 aa, Oryza sativa
MAIAVSGRWTRLRTLGRGASGAVVSLAEDGASGELFAVKTAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLRLALLGPSRPSTAHIRKPPPNPRGRSALTASASISSPRRACVDVKRGVCVAPRPHRLT

SEQ ID NO: 4467 - protein, 210 aa, Glycine max
ESATGPPPYDDLANTEAVEYLNKLAVVKLNGGLGTSMGCVGPKSVIEVRDGMSFLDLSVRQIEYLNRTYDVNVPFVLMNSFNTDTDTASIIKKYEGHNIDILTFNQSRYPRILKDSLLPAPKENKSDIANWYPPGHGDVFESLYNTGMIDKLMDRGIEYIFLSNADNLGAVVDLRILQHMVDSQAEYIMELTDKTKADVKGGTIIDYEGS

SEQ ID NO: 4468 - protein, 415 aa, Polysiphonia elongella
EASAAVAGESSTATWTVVWTDLLTACDLYRAKAYKVDAVPNTSDQYFAYIAYDIDLFEEGSIANLTASIIGNVFGFKAVKALRLEDVRLPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFGKQIGTVIIMIDLVIGYTAIQTMAIWARKNDMILHLHRAGNSTYSRQKIHGMNFRVICKWMRMAGVDHIHAGTVVGKLEGDPLMIKGFYDTLLKPFLAINLPQGIFFQQDWASLRKVTPVASGGIHCGQMHQLLDYLGDDVVLQFGGGTIGHPDGIQAGATANRVALESIVIARNEGRDYVAEGPQILLDAAKTCGPLQTALDLWKDITF

SEQ ID NO: 4469 - protein, 538 aa, Wigglesworthia glossinidia endosymbiont of Glossina brevipalpis
MIFNKIARAYIIIKIILNYGLDEIIPKKYFIFHFFRKIIFWIPNKNKNIEFSKRLILAIEKLGPIWIKFGQMLSTRNDIFKKDIIKQLQNLQNEVTPFDSKIAIRCIENSMNNKIEKIFNNFNKSPIASASIAQVYTAKLKNGKRVVVKVIRPGIIKKIKSDIKLMLVLAKFLSKIFKYGKNLRLIDIIIEYKKIILNETNLLYEAVHTIQLRRNFKESNMLYIPKVYINYCNENVMISEKINGIKISNIFDLKKNNVNMKLLAERGVKIFFTQVFRDNFFHGDMHPGNIFVSYENPDDPKYIGIDCSIIGRLTKLDKYFLAENFVAFFNRDYRKIAKLHIDSGWVDKKTNVNDLESSIRVVCEPIFEKSLSDIYFGKILLAFFSSTKDFKINIQPQLILLQKTLFYIEGIGKQLYPELNLWKTAKPFLENWIKNETRFLKILSILKENAILLAINFDGKKLFKNSFYEEREKKIKKKEKINILILCKSIFLFLLGTTIILFSLFLFMNENINQILFNILVFTSVILFIFSWKFLNRI

SEQ ID NO: 4470 - protein, 147 aa, Leuconostoc mesenteroides subsp. mesenteroides ATCC 8293
MTKYNDEELRARLTPEEYEVTQHAATERPFTGKYDQWWEDGIFVDVVSGEPLFSSTDKYDSGCGWPSFTKGIDDDEHLQENTDRSLGMTRTEITSKEAASHLGHVFNDGLPDRGGLRYCINSASLRFIPKKDLEKDGYGKYLKLFKD

SEQ ID NO: 4471 - protein, 176 aa, Zea mays
  unsure (1)..(176): unsure at all Xaa locations
SRSVDSRFDPTDEMDVSLIVQSYTRTAVPRGASAEIYEDSHLMXGRSDYLVEIVLIAGIKVCNIIVPPIVXRSPVSIWTYDNFLXQQLDATSNVXCCRLQKIAANAILGGTLAVCMAGTMENKIPHYQLLPNLVENKTLLLPVPAYTVINGGSHAVNHLALQELMMLPTADSSLNE

SEQ ID NO: 4472 - protein, 316 aa, Triticum aestivum
MASDGSGVVTVYGSGNNGAGTQLEPKSSPFSVKVGLAQMLRGGVIMDVVNAEQARIAEEAGACAVMALERVPADIRAQGGVARMSDPGLIREIKRAVTIPVMAKARIGHFVEAQILESIGVDYVDESEVLTLADDAHHINKHNFRVPFVCGCRNLGEALRRIREGAAMIRTKGEAGTGNVIEAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGEAMVGINLSDPKVERFAARSE

SEQ ID NO: 4473 - protein, 355 aa, Shewanella oneidensis MR-1
MALISLRQLLDHAAEHGYGVPAFNVNNLEQMRAIMQAAEATDSPVIVQASAGARKYARPQFLKYLMTAALEQYPDIPVCIHQDHGTDPDICQRSIQLGMSSVMMDGSLMADGKTPASYEYNVDVTRRTVAFAHACGVSVEGEIGCLGSLETGTAGEEDGVGAEGVLSHDQLLTSPEEAARFVADTHVDALAIAIGTSHGAYKFSRKPTGDVLRIDRIKEIHARIPNTHLVMHGSSSVPQEWLKIINQYGGQIPETYGVPLEEIVEGIKHGVRKVNIDTDLRLASTGAVRKYLAEHPSEFDPRKFLKASMEAMADICTVRYEAFGCAGQASKIKPLSLQAMYKAYQSGALDPKINL

SEQ ID NO: 4474 - protein, 337 aa, Ralstonia metallidurans
MALLLRVASTNVPILSHIDNGLMFFGLIIAFHNPMRPADLFRLLLLSAIWGASFLFIRIGAPVLGPLPTAFFRVLIGAVTLGACLPMLGLKWDMQGKWRAVIILGIINSGIPFVMYAIAALWLPAGYSAIFNAMTPLMGVLIGSLFFAEKLTRAKAAGVLMGLAGVGVLTRTGPVVFSHEVLLGALACLVATSCYGLAGFLTRRWITARGGLDSRLVAAGSLVGATLFLLPFSAVALWRENTLPAAGPGVWAAMLAVGMFCTAIAYVLYFRLIADLGPVRSLTVTFLIPPFGIVWGWMFLGESLSWAHAAGMALIGVAVWLVLRPAAPAVAPAPARS

SEQ ID NO: 4475 - protein, 326 aa, Escherichia coli
LPNITILATGGTIAGGGDSATKSNYTVGKVGVENLVNAVPQLKDIANVKGEQVVNIGSQDMNDNVWLTLAKKINTDCDKTDGFVITHGTETMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 4476 - protein, 637 aa, Gaeumannomyces graminis
LGEGPRYAGQLGRDSPPTSYLAGVMAEQTARGCRVGVQACTKHFIGNEQEEQRNPTAVDGKTVEAISSNIDDRTMHEAYLWPFYNAVRAGTTSIMCSYQRINGSCGCQNSKTLNGLLKTELGFQGFVVSDWAATHSGVASIEAGLDMNMPGPLNFFAPTFESYFGKNITTAVNNGTLSSRRVDEMIERIMTPYFALGQDKNYPPVDGSTVSVGFSQPGFWSHEFPLGPTVDVRRNHHEHVRELGSAGSVLLKNEKGALPLKKPMNIGVFGNDAADVTRGPYMAGGPFGGVGGDCDIGTLPLGGGSGTGRYTYVVSPLEDIKARGRSYGALVQYITSNEVITSGGLVTIFPVPEVCLVFLKSWATEGEDRISLEAQWNAAVVVEKTAALRNNNIVVHGGAPVVMSWRNNPNVTAILAAHMPGQETGTRSSTRLGRREPVGQPPYTLAGPGDRTQQNLVNESTDPDAWQADFLEGQLIDYQDFDAHNKTPAYEFGFGLSYTTFELSGVQVEVQASNPSRLPDPSAPIRAGGNVQLWETLATVKATVKKTGDREGATVAHLYLSLPGTEPGKDTPVRNLRGFEKVKIAPGASAEVEIALMRRDLSFWDTTAQSWRLPEGAIGRRVGFSSRDLKLKSEIKI

SEQ ID NO: 4477 - protein, 435 aa, Spyridia hypnoides
  unsure (1)..(435): unsure at all Xaa locations
ETDVLALFRVTPQPGVDAIEASAAVAGESSTATWTVVWTDLLTACDLYRAKAYKVDAVPNSSEQYFAYIAYDIDLFEEGSIANLTASIIGNVFGFKAVKALRLEDMRIPYAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKELGSVIIMIDLVIGYTAIQSMGIWARKNDMILHLHRAGNSTYSRQKNHGMNFRVICKWMRMAGVDHIHAGTVVGKLEGDPKMIQGFYRTLLEPFLEVDLPQGLFFEQDWASLRKVTPVASGGIHCGQMHQLIQYLGNDVVLXXXXXTIGHPDGIQAGATANRVALESMIKARNEGREYISEGPQILRDAAKTCGPLQTALDLWKDITFN

SEQ ID NO: 4478 - protein, 595 aa, Photobacterium profundum
MEFSMARMTAIEAAVEVLKREGVDIAFGVPGAAINPMYAAMKKLGGIDHVLARHVEGASHMAEGYTRTSQGNIGVCIGTSGPAGTDMITGLYSASADSIPILCITGQAPRARLHKEDFQAVDIESIAKPVTKWATTVLEPAQVPRAFQKAFHLMRSGRPGPVLIDLPIDVQLTEIEFDIDSYEPLDAYKPTASRAQVEKAITMLNDASNPVIVSGGGVINAGASALLQQFAEITGIPVIPTLMGWGSIPDNHELMAGMVGLQTAHRYGNATLLGSDFVLGIGNRWANRHTGSVDVYTEGRKFVHIDIEPTQIGRVFCPDLGIVSDAKAALELLVEVAREWKQAGKLKDRSDWAGECQHRKSTMLRKTHFDEVPMKPMRVYEEMNKAFDEDTCYVSTIGLSQIAAAQFLHVYKPRHWINCGQAGPLGWTIPAALGIRAADPDRPIVAISGDYDFQFMIEELAVGAQFKLPYIHVVVNNSYLGLIRQAQRQFDIDYCVQLAFDNQNAPELEGYGVDHVAVVEGLGCKAIRVRDPDQVGNAFAQAKELMAKHKVPVVVEIMLERVTNISMGVEINGINEFEPLAEGSADAPTAITFNQ

SEQ ID NO: 4479 - protein, 467 aa, Ptilophora mediterranea
PYAKMGYWDPDYVVKETDVLALFRITPQPGVDAVEASAAVAGESSTATWTVVWTDLLTACDLYRAKAYKVNPVPNTSDQYFAYISYDIDLFEEGSIANLTASIIGNVFGFKAVKALRLEDMRIPVAYLKTFQGPATGTIVERERMDKFGRPFLGATVKPKLGLSGKNYGRVVYEGLKGGLDFLKDDENINSQPFMRWKERFLYSMEGVNRSIAGTGEIKGHYMNVTSATMEDMYERAEFAKQLGTIIVMVDLVIGYTAIQTMAIWARKNDMILHLHRAGNSTYSRQKSHGMNFRVICKWMRMAGVDHIHAGTVVGKLEGDPLMIKGFYNTLLLSHLDVNLPQGIFFEQDWASLRKVTPVASGGIHCGQMHQLLDYLGEDVVLQFGGGTIGHPDGIQAGATANRVALEAIVIARNEGRDYVAEGPQILRDAAKTCGPLQTALDLWKDITFNYTSTDTADFVETPTANV

SEQ ID NO: 4480 - protein, 134 aa, Zea mays
  unsure (1)..(134): unsure at all Xaa locations
YAQLTVEIGQNVPIVRDDLFVTNPTRVGKVIIDSTCHALLLTVNQLVFVTDSIVPVRMYKHPXMXVMPSHMSEDTXDTFIADLSVALYTDQIKTGAHCPFDRLAKYNHVLMIHEQHRDADVYVRAQCMAPGDPY

SEQ ID NO: 4481 - protein, 225 aa, Yersinia pestis CO92
MKKYLIAPSILSADFARLGEDTAKVLAAGADIVHFDVMDNHYVPNLTIGPMVCKALRDYGITAPIDVHLMVKPVDRIVPDFAKAGATYITFHPEASEHVDRTLQLIKESGCKAGLVFNPATPLSYLDYVMDKLDVILLMSVNPGFGGQSFIPETLNKLRQVRKLIDDSGYDIRLEVDGGVKVENIRQIAAAGADMFVAGSAIFNQPDYAAVIDAMRNELAMAANG

SEQ ID NO: 4482 - protein, 163 aa, Glycine max
EAAAKKAAEDAAKQEKDGEQQASPQDTTMTKGVSAAASEAETKRTDLTVNENALLQQALAMSMDDPTINHDMRDTDMSEAAAEDPELALALQLSVEDSSKDSASQSDVSKLLADQSFVSSILASLPGVDPNDPSVKDLLASLQNQSEPQQKNEDKPPNEEEKK

SEQ ID NO: 4483 - protein, 168 aa, Avena clauda
VMASSATTVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 4484 - protein, 472 aa, Renouxia antillana
  unsure (1)..(472): unsure at all Xaa locations
ESGVIPYAKMGYWDPEYVVKETYVLALFRITPQPGVDPIEASAAVAGESSTATWTVVWTDLLTACDLYRAKAYKVDAVPNSTEQYFAYIPYDIDLFEEGSIANLTASIIGNVFGFKAVKALRLEDMRITVSYLKTFQGPATGTIVERERMDKFGRPFLGATVKPKLGLSGKNYGRVVYEGLKGGLDFLKDDENINSQPFMRWKERYLFAMEGVNRSIAASGEVKGHYXXXXXXXXXXXXXXXXXXXXXXXXXXXVGLVIGYTAIQTMAVWARRNDMILHLHRAGNSTYSRQKSHGMNFRVICKWMRMAGVDHIHAGTVVGKLEGDPLMIRGFYNTLLLTHLDINLPQGLFFEQEWASLPKVTPVASGGIHCGQMHQLLDYLGVDVVLQFGGGTIGHPDGIQAGATANRVALESVVLARNEGRDYVAEGPQILRDAAKTCGPLQTALDLWKNITFNYTSTDTADFVETPTANV

SEQ ID NO: 4485 - protein, 179 aa, Glycine max
  unsure (1)..(179): unsure at all Xaa locations
ESTNVDKGDVLGTANTERYSDLIVGLYDTLENLFASLYRNKVDISPSILHAIDRVMENVPFVNGSPHNTFVSWMIDLDIKRNSVIERDDFKIVHNKMRSEWEDFLAGAGIEAASIVSYNHLGNIDGVNVSCPQILRSKEISXTSDVDDMVNIICILYEPGEHTDHVVAINYGPCVMDSK

SEQ ID NO: 4486 - protein, 482 aa, Ralstonia metallidurans
MTETYRNYIDGEWCDSASGRTVDNVNPADTRDIVSRHAASDARDAAAAVAAAAAAFDGWKKTPIGKRAKILNDAAAHLEANADTIATELTREEGKALNLARDEVMRSAQTLRFYAVEGQTFSGESYPNDDPDMLVYSLREPLGVVTVISPWNFPVSIPARKIAPALITGNTVVFKPSSDAPLSGYRLAEAFVRAGIPKGVLNFLTGSAAEVGPTIVESREVRAVSFTGSTSAGEQIHKSVPMTTRTQMELGGKNPLIVMEDADLDRAVDLAVKGGLSLSGQACTGTSRILVMRDVKQAFTEKLVAKVKALKIGSGMTAGMDLGPLATRKQLETVLSYIAIGKQEATLLCGGEQLSDGDFAHGYYVAPTVFTDVTQSMRIAREEIFGPVLAIIEVDSYADAIAQANDTEYGLSAAIATRNPRYMHDFTRDIESGTVKINRTTTGNLVNAPFGGLKRSSTSTFRESGRAGLEFYTQIKTVYQGI

SEQ ID NO: 4487 - protein, 81 aa, Viscum album subsp. album
GFAWSWGPLGWLVPSEIFPLEIRSAAQSINVSVNMLFTFIVAQIFLTMLCHLKFGLFLFFAFFVVLMSIFVYYFLPETKGI

SEQ ID NO: 4488 - protein, 172 aa, Oryza sativa
MAPSVMASSATTVAPFQGSSPPPACRRPPSELQLRQRQHGGRIRCMQVWPIEGIKKFETLSYLPPLTVEDLLKQIEYLAPFQVVPCLEFSKVGFVYRENHKSPGYYDGRYWTMWKLPMFGCTDATQVVKELEEAKKAYPDAFVRIIGFDNVRQVQLISFIAYNPGCEESGGN

SEQ ID NO: 4489 - protein, 190 aa, Clostridium perfringens
  unsure (1)..(190): unsure at all Xaa locations
MNKKVILITGASSGIGYSTAKLLLEEGHIVYCTARRVENMRELQRLGGKIIFLDVKDERAVQKVVNTIIRMESRIDVVFANSXYACAGALETVNIDDAKEEFDVNLFGVARVIKAVMPQMRKQKYGYIIVTSSLVGIVSTPMMSFYPASKHALEGMIDGFRMENKESGIKIVKIQPSFINTEFINPFMNS

SEQ ID NO: 4490 - protein, 491 aa, Zea mays
MDPYKHRPSSAFNPPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVNFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDRFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 4491 - protein, 299 aa, Thermosynechococcus elongatus BP-1
MLMLIGSQEGTAHLPLAVMNPQEYALVLDPGYPSHVGGVYLAGGQVYPLPLRSEDHFLPDLAAIPLAVREQAKLLILSYPHNPTTAVAPLDFFKTAVEFCDRHGILLVHDFPYLDLVFDGERAPSIFEVDRDRQVGIEFYSLSKSYNMGGFRIGFAIGRADIIAALRQIKSVIDFNQYAGILRGAIAALTGDQTCVQQTREIFRQRRDVFVQALGDHGWPVPLPPATMYVWAQLPAPWQRDSLGFCQALVQATGIAAAPGSGFGQGGEGYVRFALVRDRPCLEVAAAQIAAFSQTVPKV

SEQ ID NO: 4492 - protein, 567 aa, Streptococcus mutans UA159
MEKIYLENPKSGSEILLDTLANLGVKTIFGYPGGAVLPLYDAIYKQDNIRHILARHEQGAVHEAEGFAKSTGKLGVAIVTSGPGATNAITGIADAMSDSVPMLVFTGQVATPGIGKDAFQEADIIGITMPITKYNYQIRETADIPRIVTEAVHIATTGRPGPVVIDLPKDVSEKRVSSFNETTIKIPGYQPTIEPNNLQVKKILSQLKKAKKPLILAGGGVNYAGASAELIAFAERYKIPVVSTLLSLGVMPIEHPLSLGMGGMHGSYASNMALTECDFLINFGSRFADRLTGNPKTFAQKAVVAHVDIDPAEIGKVVKTAIPVVGDAKKTLKQLLESDKVSTRHREWTDKVLQDKAKAPFSYKFDQEVIKPQHAIETIGKLTKGDAIIITDVGQHQMWAAQFYPYKNERQIITSGGLGTMGFGIPAAVGAKLANPGKEVVLFVGDGGFQMTNQELAILNGYGVPIKLVLINNHSLGMVRQWQESFYDERRSESTFDDEPNFQLLAESYGISHYKLDNPLTLEKDLEVILENKPMLIEVDISNREHVYPMVPSGKSNAEMLGVTFNA

SEQ ID NO: 4493 - protein, 206 aa, Brassica rapa
MSNEYDYLFKLLLIGDSSVGKSCLLLRFADDAYIDSYISTIGVDFKIRTIEQDGKTIKLQIWDTAGQERFRTITSSYYRGAHGIIIVYDCTEMESFNNVKQWLSEIDRYANDSVCKLLIGNKNDMVESKVVSTETGKALADELGIPFLETSAKDSTNVEQAFLTIAGEIKKKMGSHTNANKTSGSGTVQMKGQPIQQNNGGGCCGQ

SEQ ID NO: 4494 - protein, 936 aa, Oryza sativa
MAMVEQEGCVENRQPLAASSSSVSDGSSYGGGGGGLAQMSPPVSSSANSISGLRTEVQCLHRWQKVLNPELIKGPWTQEVCHVADFALMEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPHTFYYRSPKTERKGTCCSIGKFNQELCAYNQFGCNLILKMQEKLNPYRRLSMPLYHLLVIRFIADRRETSFHSTKTLCLLRSLHPRLGDPSMAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAGSVNGANCKELAAKPDVDGFLVGGASLKPEFVDIIKSATRKSSMIRHKLNTFVLRRLSITEAVQAAAMAPGRPLDDEFNFTGPIRKCVGHGCVKRGWSLAVGSLSTPAHPSSSPLQGTTDDGDRMDVGAGSSSATSQLAYKRAHARASYHGICLSWSNTPRRPERFRELHREGEIVCVVGNLAGLDRSSGEEKRKMAGSGVLEVHLVDAKGLTGNDFLGEIGKIDPYVVVQYRSQERKSSVARDQGKNPSWNEVFKFQINSTAATGQHKLFLRLMDHDTFSRDDFLGEATINVTDLISLGMEHGTWEMSESKHRVVLADKTYHGEIRVSLTFTASAKMYIQNIVES

SEQ ID NO: 4495 - protein, 356 aa, Clostridium thermocellum ATCC 27405
MSYQISIQKTQNPKNKPDQDNLGFGQIFTDHMFIMDYTEGKGWHDPRIVPYGPLSLEPSTMVFHYGQAVFEGLKAYKTEDGRILLFRPRKNMERINISNERVCIPKIDVDFAVEACKTLVSVDRDWIPEAEGTSLYIRPFIISTDPFLGVRPSWTYKFIIILSPVGAYYKEGINPVKIYVESEYVRAVKGGTGYAKTPGNYAASLIAQVKAKELGYTQVLWLDGVEKKYIEEVGTMNVFFKINGEVITPSLDGSILAGITRESTIELLRASGIKVTERKITIEEIYNAHEAGTLEEAFGTGTAAVISPIGELSWNGKVIKINDGKIGETASFVYNTITGIQSGKIEDKFGWTVEVK

SEQ ID NO: 4496 - protein, 224 aa, Amaranthus tricolor
KWHVIMACRDFLKAERAAKRIGMPKDSYTVMHLDLASLESVRQFVENFRRSGMPLDVLVCNAAVYLPTDKEPTFTAEGFELSVGTNHLGHFLLSRLLLDDLKQSDYPSKRLIIVGSITGNSNTLAGNVPPKANLGDLRGLAGGLNGVNSSPMIDGGEFDGAKAYKDSKVCNMLTMQEFHRRFHEETGITFSSLYPGCIAETGLFRNHVALFRTLFPPFQKYITK

SEQ ID NO: 4497 - protein, 363 aa, Buchnera aphidicola (Uroleucon rudbeckiae)
MKKKYRIAVLPGDGIGPEVMREAYKILNILKNHFSLPLETREFNIGGSAIDQEGTALPKKTLLGCENSDAILFGSVGGKKWDDLPINQRPERASLLPLRKHFNLFANLRPAKLYSELKYLSPLRSDIIKNGFDILCIRELTGGLYFGKPTGRLKKNNIEYAFDTEIYYNYEITRIAHLAFQLAQTRNFKICSIDKSNVLNSSVLWREIVKKVSKNYPDVHLSHLYIDNATMQIIKDPNQFDILLCSNLFGDIISDECAIITGSIGMLPSASLNEKKFGLYEPAGGSAPDIEGKNIANPIAQILSVSMLVRYGMNLKTIADKIDQSVISVLKKGYRTADISNNNNYLKTNEMGDVIANTLISGE

SEQ ID NO: 4498 - protein, 221 aa, Oryza sativa (japonica cultivar-group); identical to SEQ ID NO: 2630

SEQ ID NO: 4499 - protein, 444 aa, Zea mays
MAPTAAKDSGSADRWREVQAFEDSKLGVKGLVDSGVKSIPAMFHHPPESLKDVISPPALPSSDDAPAIPVVDLSVARREDLVAQVKHAAGTVGFFWVVNHGVPEELMASMLSGVRQFNEGSLEAKQALYSRDPARNVRFASNFDLFESAAADWRDTLYCKIAPDPAPRELVPEPLRNVMMEYGEELTKLARSMFELLSESLGMPSDHLHKMECMQQLHIVCQYYPPCPEPHLTMGVRKHSDTGFFTILLQDGMGGLQVLVDRGGGRQTWVDVTPRPGALMVNMGSFLQLVTNDRYKSVDHRVPANKSSDTARVSVAAFFNPDEKRTERLYGPIPDPSKPPLYRSVTFPDFIAKFNSIGLDGRVLDHFPVGGQRPYSSCCCCCCWLLHTTSSLVFVRSNKQFSSSSLLFFLQSEFRVLQINKGIHSLHPQSARMPSLAALVLLCI

SEQ ID NO: 4500 - protein, 406 aa, Glycine max
MLLYQPLKEEVETTIMMKGDNVLDLKTLIEELESSTIEVPSVFICPISLEPMQDPVTLCTGQTYDRSNILKWFSLGHNTCPTTMQELWDDSVTPNTTLYHFILSWFSQKYLVMKKKLEDVQGTALELLDTLKKKVKGQNIVRALKKLRQLVDSHVSTRKTVEENNGSSLISSLVGPFTSHAVGSEAIGILVNLELGSELKRNLMHPAKVSLLVDIMNEGTIQTKMNCAKLIQTLLVEGNPSETVVLSSLSLLVGVLRLVRDKKHPTSVLTGLILLKIVCSREPVRSSIISIGAVPQLIQLLPTLNNECLEIALHILEVLSTLPEGRLALKECPNIIPNVVKLLMRVSESCTQFALSILWAIYKLAPEECASKAVLKQRSTEFWKMCSLDYSTSIFISECMLAATIQ

SEQ ID NO: 4501 - protein, 405 aa, Glycine max
MVLEATMICIDNSEWMRNGDYSPSRFQAQADAVNLICGAKTQSNPENTVGVLTMAGKGVRVLVTPTSDLGKILACMHGLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAATAAAGGVSGFEFGVDPNLDPELALALRVSMEEERARQEAAAKKAAEDAANLEKGDEQQASSQHATMTERAGAATSEAENKTSDLMDDENALLQQALAMSMDDSAISHDVKDTDMSEASASDPDLALALQLSITDSAKDQSSQSDMSKLLADQSFVSSILASLPGVDPNDPSVKDLLASMQNQSEPQQKNDDKPSNEEEKK

SEQ ID NO: 4502 - protein, 405 aa, Burkholderia fungorum
MNPLLDSLQPYPFEKLRALFKDVTPNAGLAHISFGIGEPKHPTPALIRDAVVASLGGLSAYPATSGSPALRESIAKWVTQRYNLPPVDPATQVLPVSGSREALFSLAQTVLDPQKNAGGEPAIVLCPNPFYQIYEGAAILAGAQPYFVNSDPARNFACDYSAVPAEIWARTQLLYVCSPGNPTGAVLTLDDWRELFALSDRYGFVIASDECYSEIYFDEAKPPLGGLEAAHKLGRGFERLVMLSSLSKRSNVPGMRSGFVAGDAAILKDFLLYRTYHGAALSTVFQNASIAAWNDEAHVRENRAKYLQKFSTVTPMLAEVLDVRLPDAAFYLWADVSRTGLTDTVFAQRLYADYNVTVLPGSFLARTAHGVNPGRNFVRMALVADVDECTQGAQRIVDFCRALAG

SEQ ID NO: 4503 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 4504 - protein, 336 aa, Xylella fastidiosa Temecula1
MNMAIKVGINGFGRIGRNILRSAVQNFGSNIDIVAINDLLEADYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 4505 - protein, 458 aa, Thermobifida fusca
MPGRGERLRPGVDRPVQVPAGGDDRQEHAVPARREGSHQGTGVRFAAHRVVGRHRGGAGGRAQFQHRVADPQPGRGPLLCGTRAPRRKDAAPQLAFALPRVHGHPVCQRHGTAPAASRGRQDGWGGRKGETPSSADDAFQTRQCLIVRNMTDEQHSVTPVTKAVIPVAGLGTRFLPATKSTPKEMLPIVDKPAIQYVVEEAVSAGLNDILMITGRNKRSIEDHFDRAYELEEALRAKGDIERLNAVRHPSDLAQLHYVRQGEPRGLGHAVLCGAAHVGNEPFAVLLGDDLIGARETLLQRMIEVRQTYGGSVIALMEVEPDQVSLYGCAAIEPTDEPDVVTVTDLVEKPPADQAPSRWAIIGRYICDPEIFEVLRKTPPGRGGEIQLTDALRELAQRSSNGGGRVHGVLFRGQRFDTGNKLDYLRTVVEFACESPDLAKEFVPWLRDFLTRYATDSTR

SEQ ID NO: 4506 - protein, 307 aa, Akashiwo sanguinea
RIGRLVFRAASANSDVTIKAVNDPFMDLKYMVYQLKYDSVHKQFPGTIATKEEDGKEFLVINDVPIRIFHEKDPASIPWGEAGAEYVCESTGVFTQREKAELHIKGGAKKVIISAPPKDDVPIYVVGVNHKEYKTTDTVVSNASCTTNCLAPLTKVVHEKFGIVQGLMTTVHAMTATQLTVDGPSRGGKDWRGGRCASQNIIPSSTGAAKAVGKVLPSVNGKLTGMAFRVPTPDVSVVDLTCQLAKEASYDDIVAAIKEAAAGDMKGVLDWTEDEVVSTDFVSCKASSVFDVGAGIALNKTFVKLVS

SEQ ID NO: 4507 - protein, 252 aa, Lactobacillus plantarum WCFS1
MRTPIIAGNWKMNKTASEALAFVNAVKDQLPDPSKVESVVAAPALFLQEMVEAAKGSDLKIAAENAYFEDAGAFTGETSPAALADLGVDYVVIGHSERRGYFHETDEDINKKAHAIFKNGMKPIICCGESLEQREAGEAESWVSGQIKAALKDLSADQVSSLVIAYEPIWAIGTGKTATSDQAEEICAVVRKTVADLYSQEVADKVRIQYGGSVKPANVNELMGKDDIDGGLVGGASLQPDSFLELVNYQNN

SEQ ID NO: 4508 - protein, 280 aa, Oryza sativa
LCCSLLFSTDYIAYFLQIAHQNSLAVDVDLALVYASHYCKFETMACLVDEGHATSFLCPLVKASERGCLQVVQWFVNRHVSDIEMCLAVTTAASCGHFAVATYLLAHIPRHVLEALSPQILKAARGQGSGSFEGVSFLLRSNFLNDAAATYAVADSIATTSTMDIPQDLVDFLKEQWSQAAFAEGVEAGEDHFVNITRVLRRGASPIRLHDLPEPMALAIAYLPLYRACASARGQLLPQRLRGELVEAVGRLGVPVNMENNRRDFLAVLEHYFPSFITGA

SEQ ID NO: 4509 - protein, 406 aa, Zea mays
MEAPPVPELMDLDAPPPAAADAAAAAPVPPAVSDKKKEGEGGDTVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPPLFNFKHELANASPDLINRLVPEHIRRQNGVNFGHIGS

SEQ ID NO: 4510 - protein, 467 aa, Oryza sativa
MADEKLAKLREAVAGLSQISDNEKSGFISLVARYLSGEEEHVEWAKIHTPTDEVVVPYDTLEAPPEDLEETKKLLNKLAVLKLNGGLGTTMGCTGPKSVIEVRNGFTFLDLIVIQIESLNKKYGSNVPLLLMNSFNTHEDTLKIVEKYTNSNIEVHTFNQSQYPRVVADEFLPWPSKGKTCKDGWYPPGHGDIFPSLMNSGKLDLLLSQGKEYVFIANSDNLGAIVDMKILNHLIHKQNEYCMEVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 4511 - protein, 252 aa, Geobacillus stearothermophilus
RKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 4512 - protein, 336 aa, Buchnera aphidicola str. APS (Acyrthosiphon pisum)
MVKNMTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 4513 - protein, 299 aa, Phaseolus vulgaris
MSNISMVEAKLPPGFRFHPRDEELVCDYLMKKLTHNDSLLMIDVDLNKCEPWDIPETACVGGKDWYFYTQRDRKYATGLRTNRATASGYWKATGKDRPILRKGTLVGMRKTLVFYQGRAPKGRKTEWVMHEFRIEGPHGPPKVSSSKEDWVLCRVFYKSREVSAKPSMGSCYEDTGSSSLPALMDSYISFDQTQAHADEFEQVPCFSIFSQNQANPIFNHMTTMEPKLPATTYGGAPNLGYCLDPLSCDRKVLKAVLSQITKMERNPLNQSLKGSTSFGEGSSESYLSEVGMPHMWNNY

SEQ ID NO: 4514 - protein, 369 aa, Prochlorococcus marinus subsp. pastoris str. CCMP1378
MNEFDQINNLSPLPRKEIINMQSYSAPLENRRNLLRLDFNENTLGPSQRVYEAIKDINLNQISIYPEYNLLKKFVSNHYYESRQFDSEEIGLFNGADAAINAIFNSFGDRDEIFLTTNPTFGYYSPCSEIQGMRKITCAYEGENFLFPIKRFKEKIIKYKPKLIFICNPNNPTGTVVSAQEIIKLANLNKNSLIVVDELYEKFNGDSLLPVIDFKKIKNIVVIQSLSKTAGLAGLRIGFAFGHKSIMQYINKVTGPYDVNSFAVTAALAALNDKSYIDDYVSEVKKARVLIEKKFESIAIRKHFGGGNYFLIWPKKNPEILTRQMREKGILIREMKNKKDIENSIRVSIGTQEQMSLFWSTYKKLDLNN

SEQ ID NO: 4515 - protein, 311 aa, Bradyrhizobium japonicum USDA 110
MLIASGDALIDFVPTRNADGREAVMPAVGGSCLNVAIGMARLGAPTGFVGGISTDLFGQMIADHATASHVELGLATRSDHQTTLAFVRIVAGESHYAFYDAETATRNWTYRRGSVAFDTVEVLHVGSTTLVNDEGAAETKALIADARMSSTISFDPNCRPNLVRDKPAYLARMAEFAQSADLIKMSDVDFAYLFGDEPYQQRASTLLGQGTSLVVVTRGNNGAIAWHAGAGRIEVQAPRVEVADTIGAGDSFQAALLFALHKQGRLARQQLKVINADELRRALSFAANCAGLTCTRPGADPPWSHEITWSP

SEQ ID NO: 4516 - protein, 690 aa, Oryza sativa (japonica cultivar-group)
MARWWGGEGRGGSGTPVVVKMESPEWAISEVEAGAAAPGSPAAGGKAGRGKNARQITWVLLLKAHRAAGKLTGAASAALSVAAAARRRVAAGRTDSDDAAAAPPGESPALRARFHGFLRAFLLLSVLLLAVDVAAHAQGWHAVVPDLLAVEGLFAAAYASWLRVRLEYLAPGLQFLANACVVLFLIQSADRLILCLGCLWIKLKGIKPVPKASGGGGGGKGSDDVEAGADEFPMVLVQIPMCNEKEVYQQSIGAVCNLDWPRSNFLVQVLDDSDDAATSALIKEEVEKWQREGVRILYRHRVIRDGYKAGNLKSAMNCSYVKDYEFVVIFDADFQPQADFLKRTVPHFKGNEDVGLVQARWSFVNKDENLLTRLQNINLCFHFEVEQQVNGVFLNFFGFNGTAGVWRIKALEDSGGWMERTTVEDMDIAVRAHLKGWKFLYINDVECQCELPESYEAYRKQQHRWHSGPMQLFRLCFVDIIKSKIGVWKKFNLIFLFFLLRKLILPFYSFTLFCIILPMTMFVPEAELPAWVVCYIPATMSLLNILPAPKSFPFIVPYLLFENTMSVTKFNAMISGLFQLGSAYEWVVTKKSGRSSEGDLVSLVEKQPKQQRVGSAPNLDSLAKESHPKKDSKKKKHNRIYQKELALSFLLLTAAARSLLSVQGIHFYFLLFQGVSFLVVGLDLIGEQVE

SEQ ID NO: 4517 - protein, 347 aa, Triticum aestivum
MALVDALCASSVDNAALVYSTFNAAGFLFDNAAGFYDDTGIAGGPALALQAADRAPGLSAAGDVAPCLEKQATLSPAPPRRKRRRRARSCKSREETECQRMTHIAVERNRRRQMNEYLVVLRSLMPESYVQRGDQASIVGGAIDFVKELEQQLQSLEAQKRALAHQQQHKAGRDAAPLPTAMPARASTSGGIGNACVESTSNCSSSVTEADGAPDAPPFAGFFTYPQYVWRQSPRDATTLSADESRAGVADIEVTLVETHASLRVMAPRRPGQLLRMVAGLQALRLTVLHLNVTALDSLALYSLSLKVEEGCGLTTADDIAAAVHHVLCFIHAEAEAAPQQLLAPAQ

SEQ ID NO: 4518 - protein, 472 aa, Phaseolus vulgaris
MFIENFKVESPNVKYSETEIQSVYNYETTELVHENRNGAYQWIIKPKSVKYEFKTNTHVPKLGVMLVGWGGNNGSTLTGGVIANREGISWATKDKIQQANYFGSLTQASAIRVGSYQGEEIYAPFKSLLPMVNPDDIVFGGWDISNMNLADAMGRAKVFDIDLQKQLRPYMESMVPLPGIYDPDFIAANQEERANNVIKGTKKEQVQQVIKDIKEFKAATKVDKVVVLWTANTERYSNLVVGLNDTTENLLAALDRNEAEISPSTLFAIACVTENVPFINGSPQNTFVPGLIDFAIQKNCLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVADSKRAMDEYTSEIFMGGKNTIVLHNTCEDSLLAAPIILDLVLLAELSTRIQFKAEKEGKFHSFHPVATILSYLTKAPLV

SEQ ID NO: 4519 - protein, 358 aa, Campylobacter jejuni subsp. jejuni NCTC 11168
MKTYKVAVLAGDGIGPLVMKEALKILTFIAQKYNFSFEFNEAKIGGASIDAYGVALSDETLKLCEQSDAILFGSVGGPKWDNLPIDQRPERASLLPLRKHFNLFANLRPCKIYESLTHASPLKNEIIQKGVDILCVRELTGGIYFGKQDLGKESAYDTEIYTKKEIERIARIAFESARIRKKKVHLIDKANVLASSILWREVVANVAKDYQDINLEYMYVDNAAMQIVKNPSIFDVMLCSNLFGDILSDELAAINGSLGLLSSASLNDKGFGLYEPAGGSAPDIAHLNIANPIAQILSAALMLKYSFKEEQAAQDIENAISLALAQGKMTKDLNAKSYLNTDEMGDCILEILKENDNG

SEQ ID NO: 4520 - protein, 581 aa, Sorghum bicolor
MHPQRMKQAAAQQQLMQQALLLQQQQAQQPPLFPGHHHPHPGLLAAPQMEPIVSGNLPPGFDSSTCRSVYVGNISLQVTDTVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGANAGEEKQIVDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKTTIYNGVYKLRAVEESDFCEVLLYWSRLVTLVASLVVVASAVFLLEGNDAVRQGIDLLYAASTAGFAVGCWGLGVLGFLVTYLVAAQSPDEGLLTRMKGAACTACEVIVRRSKLCGGSVKECAEKGEAVVARVCTENLGMCSWGSKPTPPGTASSPLPPPAPALFSTGVSPTDFLAYQRMALNKMATNPSLMGQHALNQVALGMGGRASQSIYDGGFQGISTAAATTSAQQQQQQQQQLMYY

SEQ ID NO: 4521 - protein, 156 aa, Klebsiella pneumoniae
TDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIK

SEQ ID NO: 4522 - protein, 219 aa, Chelidonium majus
  unsure (1)..(219): unsure at all Xaa locations
GLVKKAHEISVXCDAEVALIVFSTKGKLFEYSTDSGMERILERYERYSYAERELVASELDQGNWSLEYTKLKAKIEILQKNQRHFMGEDLESMSLKELQNLEQQLDTALKQIRSRKNQLMYESISELQKKEKVLQEQNNQLGKKLKEKEKEVAQQQAQWDQQSQGQSSPSFLLSQSLPSLNIGGSYHMRGSNGSEEEGVRPQTTRTNTTLMPPWMVHHL

SEQ ID NO: 4523 - protein, 169 aa, Triticum aestivum
MRSRTKSHANRTSVDAKISELEDAEDEDAGLRDERDFKRSQVFSLTQILVLAYQSTGVIYGDIGTSPLYVYSSTFTEAPSRINLLGALSLILWSVTLMVTVKYVLIILRADNDGEGGTFSTYSLLSKYANIANRDPREATLIRMERHNTDTLGRSTRNIRSTIEKSKFF

SEQ ID NO: 4524 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVDETLKFIANRDKVAVLVGSKLRAAGAEEAAVKFTDALGGAVATMAAAKSFFPEENALYIGTSWGEVSYPGVEKTMKEADAVIALAPVFNDYSTTGWTDIPDPKKLVLAEPRSVVVNGIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKVV

SEQ ID NO: 4525 - protein, 297 aa, Candidatus Carsonella ruddii
MNIINYLYNNKKISIDSADLNLIKNFKFNSITSNPTLILKSFLNKTYNKILNLFFIKNNKKKIIDSDKEISLYDKILIFIVGNLIPYINDKISIEIPSRISFNYNLIIIYSKKIIYLCEKYGINKSFILIKIPGTDSGIKAAKKLKEIGIEVNITLIFDINQVKKCFDYGIYLISPFVGRISDNIFCKYDSGVNFVKNIFIYKNNNNYKTKIMAASFRNINQIINLRFCDCLTISPIYFNKLSKYNLKILLNNNFNNLVKFNFYNKHSSKLIIEGLKSFDKDHKRLINLLSTIINNL

SEQ ID NO: 4526 - protein, 88 aa, Zea mays
  unsure (1)..(88): unsure at all Xaa locations
MAPTVMASAGTSVAPFQGLKSTAGLPVSRRSNGASLCSVSNGGRIRCMQGWPFEGIKKCETLSYXPPVNTEALLEQEDYLVRCQGAPG

SEQ ID NO: 4527 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKAGKAHYVKFHWKPTCGVKSLLEEDAIRVGGTNHSHATQDLYDSIAAGNYPEWKLFVQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPNI

SEQ ID NO: 4528 - protein, 333 aa, Candidatus Blochmannia floridanus
MITKIGINGFGRIGRVIFREAQERTDIEIVAINDLLNIEHIAYLLKYDSTHGKFQGNIKTYSDHLIINDKTIHYTSKKKPIDLNWKNLGVDVVIESTGMFLTQEYAQGHILSGAKKVILTAPPKDDNIPMFVMGVNHDSYQGSKIISNASCTTNCLAPIAKIIHDHFGIIEGFMTTIHAVTSTQKTVDSPIHKDWRSGRSAYQNIIPSSTGAAQALGKVITDLHGKLTGMAFRVPILNVSVIDFTVRLKKSVSYKNICDVIKDASEHTFKDIIGYTEEKLVSSDLNGEKLISIFDAKSSMLLNNHFVKLISWYDNETGYSNKVIDLSNYIMKN

SEQ ID NO: 4529 - protein, 164 aa, Zea mays
  unsure (1)..(164): unsure at all Xaa locations
PSAGRPGGARHTATTTHAGPTEGNDSEETASXPSGPEPRQDXQPREEGAHXSEKRSPESARHARGARGKGARERTHDATTKTSAKXQRAPGARTPRTARTKSETHEPEXPKTSRDPRGSARNTNTREEQGGQQGKRNAQSATRDGNKDRDXXHAXEHSPRAHXQ

SEQ ID NO: 4530 - protein, 499 aa, Burkholderia fungorum
MNDFSQPVIDSIHKPRDAANPRERYAAGVMKYREMGYWQPDYAPKDTDVIALFRITPQPGVDPEEAAAAVAGESSTATWTVVWTDRLTACDIYRAKAYRVDPVPASNAAEPQYFAYIAYELDLFEEGSVANLTASIIGNVFGFKPLKALRLEDMRIPVAYLKTFQGPPTGIVVERERLDKYGRPLLGATVKPKLGLSGKNYGRVVYEGLRGGLDFLKDDENINSQAFMHWRDRFLFAMEAVNRAQAETGEVKGHYLNVTAGTMEDMYERAEFAKELGSCIVMIDLVIGWTAIQSMARWARRNDMILHLHRAGHSTYTRQRNHGISFRVIAKWLRMAGVDHAHAGTAVGKLEGDPLSVQGYYNVCRESHNEVDLSRGIFFDQPWAGLRKVMPVASGGIHAGQMHQLLDLFGDDAILQFGGGTIGHPAGIQAGAVANRVALEAMVKARNEGRDIVHEGPDILEAAARWCTPLKQALDTWRDVTFNYASTDTPDFAATPTAA

SEQ ID NO: 4531 - protein, 308 aa, Helianthus annuus
MAILSRYSSSNTLFCIEEQVHEDEDELTHQDSSAIHPLDLQDLCWEHEELVSLFTKEEEQQKQTPWPSSCTLSFRKEAVDWILKVKGCHGFTPLTAILAINYLDRFLSSLHFQKANTPWMIHLVAVTCLSLAAKIQETHVPLLLDLQLEESKFLFEAKNIQKTELLVMSTLKWRMNLVTPISFLDHIVRRLGLSNHLHWDFFKKCEAMILYLVADSRFVCYKPSVLATATMLCVVEEIDPTNSIGYKSQLLDLLKTTKDHINECYKLVMDLSYDNHNKGKRDENERTIYPVSPAGFIGFMCHESSNDS

SEQ ID NO: 4532 - protein, 2229 aa, GIBBERELLA ZEAE PH-1
MTTLLDALRQATQVDCDTLDANVQAIAFSEISRPLAGEPLLHHDALVKDAIEKARGALKEFQGSATFEEFVVQILTNPKLSYSTDGTMSDAHRIVNIFKALAPEFDTKRVCIKIPATWEGLQACRALEVEGIATLATTMFCMEQATLAADAQCTYIAPYVNELKVHFEAGYVDEHKAFDFCREAQTYYINHSCRTQVLAASLTSVDEVMQLAGIQHITISPNLLNGLASTKLSDWDGKLGDYFAQGPANKSWETRDYNALTKNESAWRMAFTRSGFGTSEGEFLFPVRARLMEKVTDISTSLAADVSDGWLQQTDPPEERVDLMIDPNSKRWTKVHRYFTKVLESDMAIEDVIRRSFTHHQYRMMAPTERTDVKEMQAANTKRYNALLAGRFKGIEDSLATRLTAMYFGLPAAPVDNPLEEIAMMLGLDEKEVPRYNFRPPLHFLTAHDRRNWGKETLKSEEATIDALPLPRAMEPTLSLRGGGDDDDLIGWTDDYTQEYETTALFTDGWTYLHGIYGRLPFVPRKWRSFSKVLRQLLQVKDYEYQDFSLLWYDRKLGKPKVIHDQLPLTKESPAMTFLDEHFADSTRSHKDCCALFIDNIHTDINKGPQHWEPIDGQLQSDTIKIGRSLGNAPNGPEDEVISYAYLAFPKTKVDTFKIGKYGSNQYNAHFCKTLNVLFGAPESSAHHHALFRLVDKKKNKTNWAVPIVYGAMGLPQWAWELLHPVNNPGADWMVECCWLNPGLEAVLLSNYYPKPNPYLITRNSRNGAERFNQAYRQICEMTTEAFDASVCRKIDSVFLIEGHKPKTAGELVIDGFQVRPRRDLKSWKLGIPGTPNDDTPRDLGKKLGESPNFYRTVHVNWRPGHCRLFPGWYSGGDFSVEMPRLSSTVVEFLEAMGELFKLVGPPNLNGTGPEDSCFLLTEAPSFDGLQVQDMDSPSYYIGVGATDDDWHDIRKSITSPFVSVSIVKKPKNTSWSTSISKHNLWGLRLDKEALRQNEMNGGGSRRDALQLYDLDGESVDILHGYPADPVPLEPIDPNNNVSVTTNGKPWTPTSRRRPDAFVPPRLLKIRSKSVGGAEGLHLPSTLVIGGASTPDGEPESDIGILATSRPKFRGFPPPPSEDEDDGDLAGGLAEDDHRRYSMYGDLLSDSGEEDGGGSRNKDADGDEAMEDTSLPSVPQADVIGGGEANDDDEDETPKLFGLQKIPEEKEPEDNPEDRPEQTVPPPSVTTSKPLFQASNTVGADDRAHTWATQPSIFTNEDQRAWPADAEIGLPITAAPVEKIHRLSGNVPMYSKAILTPTEQAELQHGFGDLRNILLKRTNMCPFQGCRFTWRLDQNEELNIHVFTAHAKRKCPFCDDALFGWWDKNQQIKHLGDKHPDEVKKMKVHGVQKGNISVPVTVNAPANLIGEAFAEEIRSWGPQYKLKAPPRLLTYPLLAWYDNFGTTAVKDPPKKCPIPSCSVPHLEHLSSHGVWTHFKNYHTDLEMDACPFCNLSFYVYGEKDKDGVRTVIPRSIDECIMHLDCHVYQLWDLLEPVVDQPTKVNMPSQGNKDFQTISAEKLESMRAEVVSKTVAAALARTGAATQSVADQSPPPQVSYGHVTDASQILRKCVYFEKCGAYVGSMTEKQYRRHVRVNHPKEISTLSSSSEDETDGEDQASTDDGSEDRGDDKPNDGDDGRDGAGKTAALKFGRLKPTSKPAQASTPSKPKEKAVLGKPPSPPDPDEMDISTDDNVVETESSRSEESAVMISEKTPTTKITTPQTPPPDGDSDTNEESGSSVSRGRRSVKALKSKRKAPTKRAEPDVDEDNTEDNGEKEIDDFDEDGEADGSGSKSSHTEGRGRSAKKAGKRRPRGDDDGDYEDEGDQDDDDFVMAGNNGRRYRRRAPSPDWIKVLGPEDPNFDPEDKMYCSKCLRKAPLRRAKSPNRSPIGRAGEIEAHTDKTKCCRIRNGLGSATGLPNRSGWIPANKLPGTLTSLKEDFLNRYPSYMRTMYPTSSRDHHASVWRSDPNNPENDAWFDVPWPPYEGLPPFPGDWIAPGLPWDDTPEGRQRRAMYIGNRVVDENYQYQSETDSDDDLKPDVNDIPDFQADLNPLKRPAEDEEETSDEPAPKKAKKSKTAATKTPKATGTKKTPAPKKAAAPSKTPAKTRSKAPSKAASKAPSKTPSKAASKTPSKAPSKTPSKAPSKAPSKASSKGPSKTPSRASSRKTTPSKTPSTPSTRPPSEAGDE

SEQ ID NO: 4533 - protein, 166 aa, Prochlorococcus marinus subsp. marinus str. CCMP1375
MNTNFFLSSRRSFLVGILSAFLGIVLGPKKVLAASNSDSWSLTKDQWKQRLSREAYYVLREEGTERPFSSLLNDEKREGIFACAGCDLPLFDSSRKFDSGTGWPSFWEPLPNAIETKTDFKLIVPRTEYHCSRCGGHQGHVFNDGPRPSGKRYCNNGVALVFTVSK

SEQ ID NO: 4534 - protein, 652 aa, Oryza sativa
MIHACSALLHTMKTGTDSGGTLHAQRSYRAFMSVVEATVTFRPRPPPRLAKRAGEAEYRRNPTTGVKCVGRPKGRKFDRAKNRKIGRGASMCPSKVLSFAGSFVEDHCPLATPPKLAGSGLRVGRGRDADKRDDFAIPHAYPGEVQKASELFVEWGNLRSPIPTRVETGTVQPSQVDHMIVHIYSTTPSVSRLCLILYICVRISDVTRQNFSLRYKHPYHSAFYHVMLRPEDWSHWRSTCYDVKVRIICESLVGPKLCRSQRYACNDATTNGPPHQRPGNCGVAVPAARANMLSAGRRCHFFGYRIHPIQAMAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKSVIKKKYGQDATNVGDEGTSISDIWYGMLFVLICQVVIGMDVAASEFYTEDQTYDLNFKEENNDGSQKISGDSLKNVYKSFVSEYPIVSIEDPFDQDDWVHYAKMTEEIGDQVQIVGDDLLVTNPTFPCWLQYSNQFDLQRVAKAIKDKACNALLLKVNQIGSVTESIEAVKMSKRAGWGVMTSHRSGETEDTFIADLAVGLSTLLRIEEELGAAAVYAGAKFRAPVEPY

SEQ ID NO: 4535 - protein, 611 aa, Novosphingobium aromaticivorans
MSLSNHVRPHRRSRARRLENRANPRHWPRAPGAYTFSSGLCKPCKPVQEAEGRNERPDPYRFGRHRPHGGRRRQGRNAPRGHRARYDPDAGADARRDPFRQRAQGRRPWPGADRGDHGGKEDWRSHPALPPPRTRRRERRFRLRRRRHRMHRHRLADWPDRGRDGGAHRRLGRVADDLRHGQGARQRHGDRSDPPRREARRQVGNVEGGGVKTPPLQLAEAQARLLALAPSLSVEHRAVAECLGHYIATPLHARRTQPAAPLSAMDGHAMRAADLPGPWRVIGESAAGHPFGGTVGRGEAVRISTGAMLPAGADMVLLQEDSARDGETLTLTGEPPAPPGRHIRPAGMDFTADTTLIEAGTRIGPAQIALAIAAGHSHLAVRRPLRLTVIDSGDELVRPGNTTRLHQLPASNGPMLCAMASALPCDISHIGPIADRIEDLAAALDGAHEADVVVTSGGASVGDHDLVRPALEAVGAKIDFWRVGIKPGKPLLVATRGNQVIIGLPGNPASAFVTAFLFLLPLLRASLGAASPLPRTIPARLAGPMGPGGSRMEFLRAHWDGNGVTLDELQDSGALSPLARANALVVREAGSERKEGGTDVPIYLLENGGIA

SEQ ID NO: 4536 - protein, 267 aa, Oryza sativa (japonica cultivar-group)
MWNFASSAWGSGLGKKNTPNCTPSNGDCSDDEASSCTSREEGLECPICWESFNIVENVPYVLWCGHTMCKNCILGLQWAIIKVPTVPIQLPFFVSCPWCNLLSLRIIYKGNLAFPRKNYFLLWMVEGMNGERARSRSAIHSEQQTTWLSSSSRASGNEGYSNPIRRPLPPPVETQSPSVNHANHGVPILNAERVQALLRKSLSFLVHLTAKFPLVFIFLLIVLYAIPASAAVLLLYILITVLFALPSFLILYFAYPSLDWLVREIFA

SEQ ID NO: 4537 - protein, 331 aa, Glycine max
MSTTVQRTPRSSRHSLFFQDLASPVSARRGKFSSPGQAAAVSSLWRENFGSSDLPPPPVFTLEDRSDFSPESGILDYQISPEAKSDTRTPIQTSNKEFSTPLKSKSEASTSYALRGVQQNQQGSPGLSWWSPTTAKSVGEQDEKGRSSPVEGVVQPGALITLPPPLEVARPEVQRNSLPAGNLNEEEWVTVYGFSPGDTNMVLREFEKCGEILKHVPGPRDANWVHILYQNRSDAHKALNKNGMQINGVLIVGVKLLDPMQRQALNERLKNQGFMPLPLASARNSEVSTLKAPSRPYYLQNGNSTARQTGGTIASPTKSLVSKIMDLMFGV

SEQ ID NO: 4538 - protein, 195 aa, Yersinia ruckeri
SIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAH

SEQ ID NO: 4539 - protein, 175 aa, Glycine max
  unsure (1)..(175): unsure at all Xaa locations
MSARLMKKVLNEQHHLPQHVSGEEEEEEEENDSEPITRSSINPFDLLNDNDSEPEDQGDELMSTNERLTSYDDEEESASLKPTAEVSTSNPKSKKKKKKKNKDSAVANKTGEDKELDLILENLSLNVNSSAEQPVSTKDKNKSVKQQAASILQVDXKCLNAENELRRIFGSKVVK

SEQ ID NO: 4540 - protein, 395 aa, Arabidopsis thaliana
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKNGIAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 4541 - protein, 178 aa, Glycine max
MACTTLFLDPNSNIFVACLVIKHLRMATFPTLHGLHNPLPRSQFLGQDHPLTHQFPLKQQVHHKTAPTHEVLMPRAAKFNILEMMGGRGLCNGEKGLQQELKRQVVVPQSSISSQEEEAPSGEKEEQEGEGGDDDEGSVKVPEDGFEKEMMGLTGGFPGGEKGLKKFIEKKQPSYKSN

SEQ ID NO: 4542 - protein, 546 aa, Hordeum vulgare
MGPDLGALALRYTGLAVSDHDSIVAINIFIALLCGCIVFGHLLEGNRWVNESTTAIVLGLITGGVILLCTKGVNSRILIFSEDIFFIYLLPPIIFNAGFQVKKKQFFRNFATIILFGAVGTLISFVIITLGAMGLFRKLDVGPLELGDYLAIGAIFSATDSVCTLQVLNQDQAPLLYSLVFGEGVVNDATSVVLFNAIQNIDLNHFDVLVLLQLIGKFLYLFLTSTVLGVAAGLLSAYIIKKLCFARHSTDREVAIMILMAYLSYMLSMLLDLSGILTVFFCGIVMSHYTRHNVTESSRVTTKHTFATLSFIAEIFLFLYVGMDALDIDKWKLASSSPKKPIALSAVILGLVMVGRAAFVFPLSYLSNLSKKESHPKISFNQQVIIWWAGLMRGAVSIALAYNKYTTSGHTAVRVNAVMITSTIIVVLFSTMVFGLLTKPLINLLVPPRPGTAADISSQSFLDPLTASLLGSDFDVGQLTPQTNLQYLLTMPSRSVHRVWRKFDDKFMRPMFGGRGFVPFVPGSPIERSVHGPGLLGTVTEAENRS

SEQ ID NO: 4543 - protein, 265 aa, Glycine max; identical to SEQ ID NO: 4443

SEQ ID NO: 4544 - protein, 153 aa, Glycine max
  unsure (1)..(153): unsure at all Xaa locations
ISNNGARDNSEWMRNGDYSPSRFQAQADAVNLICGAKTQSNPENTVGVLTMAGKGVRVLVTPTSDLGKILACMHGLEISGEMNLAAGIQVAQLALKHRQNKKQQQRIIVFAGGPVNHEKKMLEMIGRKLKKNSVALDIVNFGXEEDEGKTEKL

SEQ ID NO: 4545 - protein, 187 aa, Cryptomeria japonica
ICTYFAQPLHQRDYTRWPDKPEGWREIVDKYSEALMGLASKLLQIVSEALGLEPEAVTKACVEMDQKVVINYYPKCPQPDMTLGLKRHTDPGTITLLLQDQVGGLQATKDDGLNWITVEPVQGAFVVNLGDHMHFLSNGKFKTADHQAVVNSNYSRLSIATFQNPSQEAIVYPLKLEEGEQSFMEEP

SEQ ID NO: 4546 - protein, 694 aa, Vibrio parahaemolyticus RIMD 2210633
MKKTILALSIGLLGACSQIPENAIVLSVGDDTAVFEPNSDGLLVAEQKLEKGNYTFTIADSKQTCGNSFALAEESRIKFNTPLKMDNCATDTSMPLRIFKANTYLFTLNPDTNELTVKIKPKQSQDITYSCPVATDTAKTINVAQTFTDGTVVRDALTGQEATVANGSVTMQPGPMSQGLLLLEEVDQQAEKPFSWDNATVYFVMTDRFYNGNPDNDNSYGRSKDGKYEIATFHGGDLAGLTKKLDYIESLGVNAIWITSPLEQIHGWVGGGDKGDFKHYGYHGYYHQDWTKLDANMGTEDELRAFIDTAHKKGIRVVWDVVMNHTGYATLADMQEFGFGQLYLDDQEAKEVLGEKWTDWQPKSGQSWHSFNDYIKYGDSEAWEKWWGKDWIRTDIGDYDAPGYNDITMSLNYLPDLKTESTQKTGLPNFFRNKNTNAQDELKTPREHLITWLSDWVRDYGIDGFRVDTAKHVEMEAWAELKASTTQALAEWKQNHPDKALDDLPFWMTGEVWAHSVVKSPYFDNGFDSIINFEFQSDVAPKALKCFAQLDNDYRRYAERINSDPEFNVLSYLSSHDTQLFWSARSRSFDDQARAANALMLAPGAVQIYYGDEIARDFGVTGSDPTQGTRSDMPWDKIHGEREDLLQHWQKLGKFRQRHPAVAQGKHITRNQEGYYAFERQYQDDKVLIVYTGE

SEQ ID NO: 4547 - protein, 830 aa, Butyrivibrio fibrisolvens
MEKWARIKYTPNLPLGENGERVTASQKHIELSCEAACEGMVLLKNDRNVLPIRKGTRVALFGKGVFDYVKGGGGSGDVTVPYIRNLYEGLSQYTSDISIYDKSVRFYQEYVADQYRLGIAPGMIKEPALPEDILADAAAYADTAIIAISRFSGEGWDRKVAGVDREIKCEAKDLVEQGNKIFDHGDFYLTNAEKKMVKMVKENFSSVIVVMNVGGVVDTTWFKKDDQISSVLMAWQGGIEGGLAAARILLGKVNPSGKLSDTFAARLEDYPSTEGFHEDDDYVDYTEDIYVGYRYFETIPGAKEKVNYPFGYGLSYTTFLLEDYKAEPFVASAADEVGKSDSDLADAIVASVTVTNIGKIPGKEVVQLYYSAPQGKLGKPAKVLGGYAKTRLLQPGESQRVTIALYMEDMASYDDLGKVKKAAWLLEKGEYHFFLGTSVRDTRLLDYTYELSKNIIVEQVSNKLVPTSLPKRMLADGTYEELPQTEPVDTYATIFPRPKNWKETIEHDVLKTPVVRPQDRFQLFLPPKEGDPKKFIEVAECKVTLEDFIAQLSNEQLASLLGGQPNVGMANTFGYGNLPEVGVPNAQTCDGPAGVRIAPEVGVVTTAFPCSTLLACTWNEDICYEVGVAGGEEAKECNFGAWLTPAVNIHRSPLCGRNFEYYSEDPFLAGKQAAAMVRGIQSNNIIATPKHFALNNKESNRKGSDSRASERAIREIYLKAFEIIVKEQSPGASCLQYNIVNGQRSSESHDLLTGILRDEWGFEGVVVSDWWGFGEHYKEVLAGNDIKMGCGYTEQLLEAIDKKALKRKDLEKRQSESSRCFSNSTKLKAA

SEQ ID NO: 4548 - protein, 448 aa, Zea mays
  unsure (1)..(448): unsure at all Xaa locations
SRASYTCFFLEPLHLVCQSLPQDNVFIISNPKSKYPVLQLDLRLISDLVVVIVSATCGGIAFACLGQPVITGYLLAGSIIGPGGFSFVNEMVQVETVAQFGVIFLLFALGLEFSTAKLRVVRAVAVLGGMLQIMLFMFLCGILATLCGGKTKEGVFVGVLLSMSSTAVVLKFLMERNSINALHGQVTVGTLILQDCAVGLLFALLPILSGTSGLLHGVASMTKSLVVLITFLTILSILSRTGVPWFLKLMISLSSQTNELYQLAAVAFCLLFAWCSDKLGLSLELGSFAAGVMISTTDLAQHTLEQIEPIRNLFAALFLASIGMLINVHFLWNHVDILLAAVILVITVKTFIVAIVVKGFGYSNKTSLLVGMSLAQIGEFAFVLLSRASSIHLIEGKLYLLLLGTTALSLVTTPLLFKMIPAXVVHLGVLLRWFSVDTNQVEVHDHTS

SEQ ID NO: 4549 - protein, 567 aa, Oryza sativa
MIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPRGGDNHVAIDLIVQHIRTKLGQHDLCKIYPNVYVVNTTFQIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGSVEFIQCSFHSDVCLLVGMRTTEVTAKVSYHNYSTVQRFPRLKIVTSEIETGLNEEYRVIPGLGEYGDRYFVVIELHANETYICMYCKVHAYGPDNCLRIVEAALLAGNAVVSARSRTRFTSIRPNSFDTRPNYGRFGQRHASQPKPNRARGGEGERRRRGVVVSRQHTHSHAGTPPPPHPLLIAAAVAARPHLSRRLHSLAVAGRRRRPPRAVNSRLVSDKVQNDGFGADSTSTVEAS

SEQ ID NO: 4550 - protein, 240 aa, Papaver somniferum
VQLRRMENKINRQVTFSKRRSGLLRPCAEMSVLCDAEVALIVFSTKGKLFEYSTDSGMDRILERYERYSYAERELVTTEIDQGNWSLEYSKLKSKIEILQKNQRHFMGEDLQSMSLKELQNLEQQLDVALKQIRSRKNQLMYESISELQKKEKALQEQNNKLGKQLKEKEKEVAAQQQQASQFSQGQSSPSFLLSQSLPSLNIGSGSYQARGGDNGNEEGNRTQTTRTNTATLMPPWMLN

SEQ ID NO: 4551 - protein, 422 aa, Streptomyces avermitilis MA-4680
MTQSGAGPSGGFGLRRTLGVGDAVVVGLGSMVGAGIFAALGPAARAAGSGLLLGLAVAAVVAYCNAMSSARLAALYPASGGTYVYGRERLGAFWGYLAGWAFIVGKTASCAAMALTVGAYVWPGQAHAVAVAAVVALTAVNYGGMQKSALLTRAIVAVVLAVLASVVVVCLGSGAADAGRLAVGLSGGAGGVLQAAGLLFFAFAGYARIATLGEEVRDPERTIPRAIPLALGIALVVYAAVAVGVLSVLGADALGHAPAPLADAVRAAGVPGLVPVVRVGAAVAALGSLLALILGVSRTTLAMARDRQLPGALAAVHPRFQVPHRAELAVGAVVAALAATVDVRGAIGFSSFGVLAYYAVANASAWTLSSAPASRAVPAVGLLGCVTLAFALPAVSVGVGAAVLGLGAAAYGMRRWGASRRP

SEQ ID NO: 4552 - protein, 595 aa, Oryza sativa
MVEVGGRVRGFVRNRWLVFVAAMWMQSFAGVGYLFGSISPVIKASLGYNQREVAGLGVAKDLGDSVGFLAGTLSAVLPLWAAVLVGAAQNLFGYGWVWLAVTHRAPVPPLWAMCILIFIGTNGETYFNTAALVSCVQNFPKSRGPIVGILKGFAGLSGAILTQMYAMIHSPDHAALIFMVAVGPTMVVIALMFIVRPVGGHRQVRPSDGTSFTFVYSVCLLLAAYLMGVMILGDLVDLSHTVMVLLTIILIVLLIVPIVIPVILSFFSDNDESAYASLLQSPGKEEASASTPSEEQTEVIFSEVEDEKPKEVDLLPASERQKRIAELQTKLFQAAAVGAVRVKRRKGPRRGEDFTLMQALIKADFWLLFFSLLLGSGSGLTVIDNLGQMSQSLGYEDSHIFVSMISIWNFLGRIGGGYFSELIVKDYAYPRAIALATAQVFMAFGHFSFAMAWPGAMYIGTLLVGLGYGAHWAIVPAAASELFGLKNFGALYNFLTVANPAGSLVFSGIIASGIYDSEAEKQAHQHHNSTLLAMPGRLLAMASDATQPLKCEGAICFFLSSLIMSGFCIVAAVLSLILIYRTKIVYANLYGNPRT

SEQ ID NO: 4553 - protein, 457 aa, Pachydictyon coriaceum
DYNVKETDILALFRITPQPGVDPIEAAAAVAGESSTATWTVVWTDLLTACDIYRAKAYRVDPVPGTNDQFFAYIAYECDLFEEGSLANLTASIIGNVFGFKAVKALRLEDMRIPYAYLKTFQGPATGVIVERERLDTFGRPLLGATVKPKLGLSGKNYGRVVYEGLRGGLDFLKDDENINSQPFMRWKERFLYCMEGVNRAAAATGEVKGSYLNVTAATMENMYERADYANSIGTVIVMIDLVVGYTAIQTMAIWARKAQMILHLHRAGNSTYARQKNHGINFRVICKWMRMSGVDHIHAGTVVGKLEGDPLMVKGFYNTLLLTELKVNLAEGLFFDMDWASLRKCVPVASGGIHCGQMHQLLYYLGDDVVLQFGGGTIGHPDGIQSGATANRVALEAMVLARNEGRDYVAEGPEILRTAAATCGPLKTALDLWKDITFEYTSTDTPDFVDTPTGSR

SEQ ID NO: 4554 - protein, 254 aa, Schizosaccharomyces pombe
MSRKNLIKLNHDPTVTYSTKDDADELFDDLSSSPLHENVSWISWFCSRPGREYFVEVKEDFIEDLFNLTGLNLAVPFYNEALDLILDRTAPDTLENFDMDVIETSAQILYGLIHQRYIITRTGLHQMAEKYSMGIFGCCPRVNCCYTHVLPAGLSDIVGKMPVMLFCPNCLDLYAPSSSRYKNIDGSFFGATFPHLFFESYPELNPKRSIPCGKIYQPRIYGFKVSELSKTGPRMQWLRMYLEDSGSDSESESD

SEQ ID NO: 4555 - protein, 311 aa, Oryza sativa
MSARLLRRVLQERETAPQDPAAAATAAAEVEREEEEEASPPRVAARNPFDLLDEEEEEEEEKEDEVYSEQPVSYNEQKHSVNKKPGNAVPETNKKSKKKKKKSKADKQVSTKSRDEKSLDSILEDLSIEKKPMQQRVNQNERASGKEIEIDETTPGTSSILSIDPKHLKAENEMRRIFGSKVVDSLENQRNVPSSSTSRLRGVRRVAHNPRKTLLVTPSSYWPPWDKSMSMDIVETKSGFNYFRYIYDPSVSHVQDLFEVAKSANDLNAIAAILAKYPYHPESLLTFAELFKYSGEHQSSADAVEKCLFAL

SEQ ID NO: 4556 - protein, 357 aa, Pinus radiata
MGSLETEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTGPGKKCGILGLGGVGHMGVKIAKAFGLHVTVISSSDKKKEEAMEVLGADAYLVSKDTEKMMEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLEKNDVRYRFVVDVAGSKLDN

SEQ ID NO: 4557 - protein, 452 aa, Lupinus luteus
MASRPTVRLQQQARDEEVVGGGKQQKNGAGDGKNRKALGDIGNLDHVKPNRPVTRSFCAQLLANAQAAAAAENKKKLAIPNVADPKPNVADGVVAKRVAPKPAEKKVTAKPKAQEVIEINPAEEAQKNKSVNKKKEGGENKKKSRTLTSVLTARSKAACGLTNKPKEKIIDIDAGDSGNELAAVEYIEDIYKFYKLAENENRPHQYMDSQPDINEKMRAILVDWLINVHTKFDLSLETLYLTINIIDRFLALKTVPRKELQLVGISAMLMASKYEEIWPPEVDEFVCLSDRAFIHEEVLAMEKIILGKLEWTLTVPTPYVFLVRFIKASVPDQELENMAHFLSELGMMHYGTLMYCPSMIAASAVFAARCTLNKTPIWNETLKLHTGYSKEQLMDCAKLLVSFHSSIRGEKLKVLYRKYSDPERGAVAVLSPAKNLMSEGGGIDLSVVENNI

SEQ ID NO: 4558 - protein, 632 aa, Bacillus subtilis subsp. subtilis str. 168
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGVDRKHPGIQKALRWLKSIQNDDGSWGESCKSAEIKTYVPLHRGTIVQTAWALDALLTYENSEHPSVVKGMQYLTDSSSHSADSLAYPAGIGLPKQFYIRYHSYPYVFSLLAVGKYLDSIEKETANET

SEQ ID NO: 4559 - protein, 499 aa, Pseudomonas putida
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTGKCAALNMRNPGSYYFCAAGGLGFALPAAIGVQLAEPERQVIAVIGDGSANYSISALWTAAQYNIPTIFVIMNNGTYGRFAMVCRRSRSRKRSWAGCARDRLPRTRQGLWCPSAESRQP

SEQ ID NO: 4560 - protein, 481 aa, GIBBERELLA ZEAE PH-1
MAVGSSKQINFTEFYNLIDGKLETTKETLQNTNPSTLEKNHPAPVATQEDVDRAVEAAKKASESWSEVPWEERQALVTKYAEGIDALKDEFAHLLVKEQGKSLAMAHFEIMLSVQFLKGYASLPDPQRVIEDKPDCKVVTKYVPLGVAVGIVPWNFPIFLTTAKIGPALIAGNSFILKPSPFTPYCGLKLAELASQYFPSGVVQALSGDDNLGPWLTAHPGVDKISFTGSTATGKKVVASAAPTLKRVTLELGGNDPSIVCDDVDVKEVAPKIAFAALMNSGQLCMAIKRVYVHESIYDDFVKELAAAVNSFTVGDGMDEKTSLGPVQNQMQFDRVKNLLADIESNGYKLAAGSTSASTAGKGYFITPTIVENPPDESRIVVEEPFGPVFPVLKWTDEADVLRRANDTDMGLSASVWTKDMEKAERLSSKIKAGTVWVNNHVQLNPAVPFGGAKHSGHGAEHGIEGIKAYCTTKSLYFNKA

SEQ ID NO: 4561 - protein, 74 aa, Glycine max
PIILERVDPAELSSRVELNTENEAILHSFHRVDSIQSGLGKAHLVPPGCSIVDALSKQGAMLESIMSVCVGLAP

SEQ ID NO: 4562 - protein, 186 aa, Emericella nidulans
MSSTSPSKEPEVEQEPHSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGDPSAELPAALQSCVPGVLQLEAPSPKPLIMQAAL

SEQ ID NO: 4563 - protein, 386 aa, Lycopersicon esculentum
MALHATAFSFTGVSTSSKSSRSALLSLPRRCAVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNTLLKSVA

SEQ ID NO: 4564 - protein, 360 aa, Trichodesmium erythraeum IMS101
MINCRITLLPGDGIGPEIMAVAVDVLKVVGKQFNLEFEFQEAPIGGVAIDATGEPLPKETLEMCRNSNAVLLAAIGGYKWDNLPRHQRPETGLLGLRAGLGLFANLRPAKIFPQLIDASTLKREIVEGVDIMVVRELTGGVYFGTPKGVFETETKEKRGVNTMAYSESEIDRIAKVGFETAQKRGGKLCSVDKANVLEVSQFWRDRINLVAQEYQDVELSHLYVDNAAMQLVRFPKQFDTIVTGNLFGDILSDAAAMLTGSIGMLPSASLGASGPGVFEPVHGSAPDIAGQDKANPLAQVLSVAMMLRYALEQPVVADKIEQAVLQVLEQGYRTGDIMSEGMKLVGCKEMGEVLLKILSL

SEQ ID NO: 4565 - protein, 242 aa, Nicotiana tabacum
MGRGKVQLRRIENKINRQVTFSKRRGGLAKKAHEISVLCDAEVALIVFSHKGKIFEYSSDSCMEQILERYERYSYAERRLLSSNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDKTVGKQAEWHQQNQVPNSASFLLQPHPCLNIGGNYQEEAEEARRNELDLNLDSLYPCHMGCFAT

SEQ ID NO: 4566 - protein, 479 aa, Schizoseris multinervis
RLKNDRYESGVIPYAKMGYWDPDYVIKETDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAASGEIKGHYMNVTAATMEEMYERAEFAKQLGTVIVMIDLVIGYTAIQSMGIWARKNDMILHLHRAGNSTYSRQKIHGMNFRVICKWMRMAGVDHIHAGTVVGKLEGDPKMIKGFYDTLLKPFLDINLPEGIFFTQDWASLRKVTPVASGGIHCGQMHQLLDYLGNDVVLQFGGGTIGHPDGIQAGATANRVALESMVIARNEGRDYVTEGPQILRDAAKTCGSLQTALDLWKDITFNYTSTDTADFVETPTANV

SEQ ID NO: 4567 - protein, 511 aa, Manihot esculenta
MSVAILTSLPPQWLSILAVFLLPILTLLLFRGKDDNQKKGLKLPPGPRQLPLIGNLHQLGGQPYVDFWKMAKKYGPVMYLQLGRCPTVVLSSTETSKELMKDRDVECCSRPLSVGPGQLSYNFLDVAFSPYSDYWREMRKLFIFELLSMRRVQTFWYAREEQMDKMIEILDGAYPNPVNLTEKVFNMMDGIIGTIAFGRTTYAQQEFRDGFVKVLAATMDMLDNFHAENFFPVVGRFIDSLTGALAKRQRTFTDVDRYFEKVIEQHLDPNRPKPETEDIVDVLIGLMKDESTSFKITKDHVKAILMNVFVGGIDTSAVTITWAFSELLKNPKLMKKAQEEVRRAVGPNKRRVEGKEVEKIKYIDCIVKETFRKHPPVPLLVPHFSMKHCKIGGYDILPGTTIYVNAWAMGKDPTIWENPEEYNPDRFMNSEVDFRGSDFELVPFGAGRRICPGLAMGTTAVKYILSNLLYGWDYEMPRGKKFEDFPLIEEGGLTVHNKQDIMVIPKKHKWD

SEQ ID NO: 4568 - protein, 196 aa, Clostridium perfringens str. 13
MFLMIDNYDSFVFNLLRYFKELNEDIKIKRNDKITIEEIKKLNPEGIIISPGPKAPKDMKECLNIIEEFKGKIPILGVCLGHQCIGYSFGSKIKKGDFPVHGKVSKITHDGKGIFKGIKNNINVTRYHSLVVDRNFLGEDLEITALSDDGVVMGIRHKRYNIEGVQFHPEAVLTEYGHEMLKNFIDNARKFNIIER

SEQ ID NO: 4569 - protein, 255 aa, Clostridium tetani E88
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 4570 - protein, 313 aa, Oryza sativa (japonica cultivar-group)
MAMRKRMRGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAVKPVKGDTVLFFSLHIDGVPDPLSLHGSCPVIEGEKWSAPKWIRIRSYEHPPVSKVTEGCSDNSARCAKWAEAGECEKNPVYMVGAEGLPGNCRKSCGVCDS

SEQ ID NO: 4571 - protein, 550 aa, Oryza sativa
MVLELEATVICVDDSEWMRNGDYPPTRLQAQEDAANLVVGTKMTSNPENTVGVLAMAGDRVRVLLAPTSDPVKFLACMHGLEASGEANLTATLNIAELVLKNRPDKRLSQRIVVFVGSPVKDEKLETIGKKLKKYNVSLDVVEFGESDDEKPEKLEALVAAVGGSSHIVHIPPGEDLRAVLANTPIITGDEGGGAAAGGASRYEYNVDPNVDPEFAEALRLSEIARQEAAADGASRYEYSVDPNADPELAETFRLAAGEPSTSNTDTVLLESDSDTYVPFHEFIQNNPFVTGAESASDRPADDERATEEGFRMIREALARSANAAHAEISGNSSSGQELELGWQVALLVFLSHFFVNNTGIKQYPQRTGEICFQFEVEDIINLICWQGWQQCKYRRSCPSTRTRKLGHPRSRAEDARAALVGDRSRGGGGAAPGRLRWLRCAEARGAMEAADARMAGGGGGATRGRAGLVEARGAGRGGRVARGLALVHRLVANGDPRSTPWSRRARSSPLMSPSCSPSSLTASSTWSTAKQIDDLLAFYGWCDDVGLAR

SEQ ID NO: 4572 - protein, 413 aa, Kluyvera cryocrescens
MAESSPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVELPKASMYVWAKIPDKYAAMGSLEFAKKLLQDAKVCVSPGIGFGEYGDTHVRFALIENRDRIRQAIRGIKAMFRADGLLPSEHKSRIDFCVA

SEQ ID NO: 4573 - protein, 344 aa, Thermus aquaticus
MRVAVLPGDGIGPEVTEAALRVLKALDEREGLGLTYETFPFGGAAIDGYGEPFPEVTRKGVEAAEAVLLGSVGGPKWDALPRKIRPESGLLALRKSQDLFANLRPAKVFPGLERLSPLKEEIARGVDVLIVRELTGGIYFGEPRGMSEAEAWNTERYSKPEVERVAKVAFEAARKRRRHLTSVDKANVLEVGEFWRKTVEEVHKGYPDVALDHQYVDAMAMHLVKNPARFDVVVTGNIFGDILSDLASVLPGSLGLLPSASLGRGTPVFEPVHGSAPDIAGKGIANPTAAILSAAMMLEHAFGLVELARRVEAAVAKALRETPPPDLGGSAGTQAFTEEVLRHL

SEQ ID NO: 4574 - protein, 471 aa, Laurencia flexuosa
SGVIPYAQMGYWDPNYVVKDTDILALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLEPYLKVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 4575 - protein, 497 aa, Zea mays
  unsure (1)..(497): unsure at all Xaa locations
LGPTFIKLGQLSSTRSDLFPREFVDELAKLQDRVPAFSPEKAKAFIEKEMGCSIDVVYKEFEERPIAAASLGQVHRAMLHNGERVAVKVQRPGLKKLFDIDLRNLKLVAEYYQRSETFGGPSRDWIGIYEECSKILYEEIDYINEGKNADKFRRDFRNIKWVRVPLIMWDYTTEKVLTLEYAPGIKINNLDVLDNRGYSRSLIASRAIESYLIQXKTGFFHADPHPGNLAVDKDGSLIYYDFGMMGEIKQFTRERLLSLFYSVYEKDANKVMKALIDMEALQPTGDLSPVRRSIQFFLDNLLSQTPDQQQTLAAIGEDLFAIAQDQPFRFPSTFTFVIRAFSTLEGIGYILDPEFSFVKVAAPYAQELLDLKQRRQTGPQLVQEIRKQANDARDSTISMPYRIQRIEDFVGQLETGDLKLRVRVLESERAARKATVLQMATMYTALGGTLLNVGVTLNSQGNQIIANGSFIGAGIFLALLVRSMQRVKKLDKFETMI

SEQ ID NO: 4576 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 4577 - protein, 297 aa, Rhodobacter sphaeroides
MGTRFLPATKSIPKEILTLVDKPLIQYAVEEAREAGIEDFIFVTSRGKGALEDFFDVNQTLERALRAAGKTELLATLEATNIDSGHVTYVRQHEALGLGHAVWCARRLVGDEPFAVILPDDMVVADKPCLAQMIEAHEEVGGSIIATMEVPAEKASSYGVLDIEERQGALIRPRGIVEKPKAGTAPSNMAVIGRYILGPRVMQHLDRRTVGAGGEIQLTDAIAHELATHPGSVHGFRFQGERFDCGSKAGFLQATVALALEREDLRGEFSTFLRAIAEQHGLGAPSAAPLRSVAAAS

SEQ ID NO: 4578 - protein, 299 aa, Zea mays
QSVPGLVILYGSIVKKKWAVNSAFMALYAFAAVWLCWVMWGYQMSFGQKLLPFWGKAGHTLGQGFLLSQAGLPATGEITPLYPMASMVYFQCVFAAITLILLAGSLLGRMNFKAWMLFVPLWLTFSYTIGAFSIWGGGFLFHWGVIDYSGGYVIHLSSGVAGFTAAYWVGPRLTKDRERFPPNNVLLMLTGAGILWMGWAGFNGGDPYAANIDSSIAVVNTNICAATSLLVWTCLDVIFFKKPSVIGAVQGMITGLVCITPGAGLVQGWAAIVMGMLSGSIPWCTMMVVHKRSRLLQAC

SEQ ID NO: 4579 - protein, 271 aa, Malus x domestica
MGRGKVQMKRIENKISRQVTFSKRRSGLLKKAHEISVLCDAEVAVIVFSTVGKLFEYSTDFSMVRILDRYDQYSYAERQRTGADSESQENWPVEYPKLAARIEVLQRKLRNLVGEDLDPLSLRELQDLEQQLDTALKRIRARKNQLVHESISEMDKKRKALRELNKSLAKKVKENKTMLEEEHDQVQVVGQQQTNQGRHNSSTLMLMPPPPQPPSTPTLPTFRTTRKSCSGGVQARGAVDDNDSDKGGRPPPRPAAATNTRMPLWMLSPFE

SEQ ID NO: 4580 - protein, 97 aa, Zea mays
MEDEEHEVYGQEIPVDGEDVDMAAGDDATKLQELDDMKRRLKEMEEEAAALREMQAKVAKEMQGVDPNATTSENKEEMDSRSVFIGNVSFISSLYVN

SEQ ID NO: 4581 - protein, 372 aa, Novosphingobium aromaticivorans
MANAPQLPASPQPKDWILGIHAYVPGKSTGKDGQVLTKLSANENPLGTSAAALEARAHAGDPARYPDPDSKDLRAAIGEVHGIDPSRIVMGTGSDELLNLAAQAYAGPGDEVLYVRYGFSVYDIAARRCGAVPVVAPDADYGTDVDALLACVTERTRVVFLANPNNPTGSWLPREEVARLHAGLRSDILLVLDGAYAEYLDPANDDGALDLAVTACNVLVTRTFSKIYGLAGERIGWGTGHPAIVDMLNRIRGPFNISLTGQAAGLAAVRDQAFVEASRRHNAHQRTRFVGKLEALGNHGVRPLPSQANFVLILFEGKVTAEDVYLGLMDYGYITRWLPGQGLPQALRITIGTEAQMDEIADAIRRMCEAAR

SEQ ID NO: 4582 - protein, 452 aa, Porphyra rediviva
ETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASAAAGEIKGHYLNVTAATMEDMYERAEFSKVVGSIICMIDLVIGYTAIQSMAIWARKNDMILHLHRAGNSTYSRQKNHGMNFRVICKWMRMAGVDHIHAGTVVGKLEGDPLMIKGFYNTLLAGETEINLPQGLFFAQNWASLRKVVPVASGGIHAGQMHQLLDYLGDDVVLQFGGGTIGHPDGIQAGATANRVALESMVMARNEGRDFVAEGPQILRDAAKTCGPLQTALDLWKDISFNYTSTDTADFVETPTANV

SEQ ID NO: 4583 - protein, 56 aa, Synechocystis sp. WH 8501
MLILPGTTVKVTNPNDTYYKFEGLVQRVSDGKAAVLFEGGNWDKLITFQLSEIEPV

SEQ ID NO: 4584 - protein, 170 aa, Oryza sativa (japonica cultivar-group)
MAAAAQAPAAAKVVVATSPRAGGGGGGGGDRKVVPVVVAAAAGDEAQSEMHVLAVDDSSVDRAVIAKILRSSKYRVTTVESATRALELLCLGLVPNVNMIITDYWMPGMTGYELLKRVKESSQLKEIPVVIMSSENVPNRISRCLEEGAEDFLLKPVRPSDVSRLCSRIR

SEQ ID NO: 4585 - protein, 295 aa, Bradyrhizobium japonicum USDA 110
MVPDTNSISHSRTWTFFRGQWHEGNVPIMGPRTHGLWLASTIFDGARAFEGVMPDLDRHCARVNQSAVNFGLKPVVDLDTWLGLVREGIARFPVNAELYIRPMYWPQNGIGGGVLFDPETTDWCLCIYESPIPEPVGSAITLSPFRRPTAECAPADVKASCLYPNSSRALREAASRGFQNCLMLDMLGNVTEFGNSNVFMAKDGVVFTPAPNGTFLNGITRQRVIELLRGDGITVLEATLRYSDFVSADEIFSTGNFAKVAPVIRIDDRQLRPGRFYARARKLYWDFAHGMKLAA

SEQ ID NO: 4586 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 4587 - protein, 499 aa, Glycine max
MEHCNCYMFTLSLLLLLLLTPPSLSDDLGFDFPAKKLIRDLNLFPSEDVNIVPRHSNSHANKIVEKPLRFPNLVPSDSGISLDDLAHRAGYYLIPHSHAAKMFYFFFESRNSKKDPVVIWLTGGPGCSSELAVFYENGPFKIANNMSLVWNEYGWDKVSNLLYVDQPTGTGFSYSTDKRDIRHDEEGVSNDLYDFLQAFFAEHPEYVKNDFFITGESYAGHYIPAFAARVHRGNKAKEGIHINLKGFAIGNGLTDPGIQYKAYTDYALDMGIIQKADYERINKVMVPACEMAIKLCGTDGKIACTASYFVCNTIFNSIMSHAGDINYYDIRKKCEGSLCYDFSNLEKYLNQKSVRDALGVGDIDFVSCSSTVYQAMLVDWMRNLEVGIPALLEDGINMLVYAGEFDLICNWLGNSKWVHAMEWSGQQEFVVSSEVPFTVDDSEAGLLKKYGPLSFLKVHDAGHMVPMDQPKASLEMLKRWTQGTLSESAADAEKLVAEL

SEQ ID NO: 4588 - protein, 374 aa, Oryza sativa
  unsure (1)..(374): unsure at all Xaa locations
MVVHVVYRRRESSWRGGETSARLHQGAAAMSNPAGGKHLVRLAGSSSLRGGAALSPAVSISSGSRPATRAGARALRAASPPPACSIASVGCWESRALRLDGDEDWEVVVAQGDDAVGADSGAFDAVQEAADEHAEAFGAPPTDQEVRAARASIPEVFVNHPGLGSDAPAQALALSPISGLPPSGMFVNYFSEGSTPSDIKIEDSTPSDVKIDQLASLEHSTPELHQRNVFEPANALSFNSTALLTREHXRNVLDAFHLLQVDSSVQKMVMALSTDKSVWDAVMKNEVVQEFRKSFQDAKEADPNGSSSASPGVMKWVMETTQAKIKEFLESILKLVNMLFQAQSEDYDLYDDTVRMSFMLAVFVFIVVTVARIK

SEQ ID NO: 4589 - protein, 471 aa, Cryptonemia luxurians
SGVIPYAKMGYWDPDYVVKETDVLALFRVTPQPGVDPIEASAAVAGESSTATWTVVWTDLLTACDLYRAKAYKVDAVPNSSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAGNIEDMYERAEFAKQLGTVIIMIDLVIGYTAIQTMGIWARKNDMILHLHRAGNSTYSRQKSHGMNFRVICKWMRMAGVDHIHAGTVVGKLEGDPLMIRGFYNTLLFTHLDVNLPQGIFFEQDWASLRKVTPVASGGIHCGQMHQLLDYLGEDVVLQFGGGTIGHPDGIQAGATANRVALESMVIARNEGRDYVAEGPQILQDAAKTCGPLQTALDLWKDITFNYTSTDTADFVETPTANV

SEQ ID NO: 4590 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 4591 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 4592 - protein, 527 aa, Triticum aestivum
MALEAANHYLQLAGVHGTSTPAVLLTVLLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAANIIRYGPTDIAFAPYGEYWRQARKLLTTHMLSAKVVHSFRHGRQEEVRLIINKIRAAATRGTAVDMSELLSGYTNDVVCRAVLGESHRKEGRNRLFSELTEINVSLLGGFSLENYIPPNMVMADALLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDLSSMAYLRATIKETLRMHPPAPFLLPHFSTADCKIDGYLIPANTRVLVNAWALGRDPSSWERPEDFWPERFLQDQDGDVDTQMRGKDLRFLPFGFGRRICPGMNFGFATMEVMLANLMYHFDWDVPNMVGTGAGVDMAESFGLTLRRKEKLQLVPQIP

SEQ ID NO: 4593 - protein, 347 aa, Emericella nidulans
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDSSGALNLLDNLLVFDPDRRISAEQGLMHPWMAPYHDPTDEPVATEQFDWSFNDADLPLDTWKIMMYVHHCSDVVSFTL

SEQ ID NO: 4594 - protein, 340 aa, Ipomoea batatas
MSRLSGITPRARDDRSQFQNPRLEIAVPDRTAGLQRTKRTLLVKCVLDETKQTIQHVVTEKNEGTLLDAASIASSIKYHAEFSPAFSPERFELPKAYFATAQSVRDALIVNWNATYDYYEKLNMKQAYYLSMEFLQGRALLNAIGNLELTGEYAEALNKLGHNLENVASKEPDAALGNGGLGRLASCFLDSLATLNYPAWGYGLRYKYGLFKQRITKDGQEEVAEDWLELGNPWEIIRMDVSYPVKFFGKVITGSDGKKHWIGGEDILAVAYDVPIPGYKTRTTISLRLWSTKVPSEDFDLYSFNAGEHTKACEAQANAEKVYVTYSTLGMNQLKEKFYD

SEQ ID NO: 4595 - protein, 734 aa, Streptomyces coelicolor A3(2)
MASSTRRHGAARSAREGSRRRLPLRLLLPLLVLVALVAMLMLRGYVHSEILADHRVQPPAATDKVPQKILEGGPVIDVRGGRTESLSVPDHRLVLTFDDGPDPTWTPRVLDVLKKHDAHAVFFVTGTMASRYPDLVERMVDEGHEVGLHTFNHPDLSFQSEKRIDWELSQNQLAITGAAGVRTSLFRPPYSSFADAMDNKSWPVTEYIGGRGYLVVVNNTDSEDWKKPGVDEIIRRATPKGGKGAIVLMHDSGGDRHQTVQALDRFLPDLKKKGYEFDNLTEALDAPGAMSPVTGAELWKGRAWVFLVQASEKLTDGLVVGLAVIGTLVIGRFVLMLLLSGVHARRVRRRRFRWGPAVTEPVTVLVPAYNEAKCIENTVRSLVASDHPVEVIVIDDGSSDGTARIVEGLGLPGVRVIRQLNAGKPAALNRGLANARYDIVVMMDGDTVFEPSTVRELVQPFGDPRVGAVAGNAKVGNKDSLIGAWQHIEYVMGFNLDRRMYDVLGCMPTIPGAVGAFRRSALEPIGGMSDDTLAEDTDVTMALHRAGWRVVYAENARAWTEAPESVGQLWSQRYRWSYGTMQAIWKHRRAVIEKGPSGRFGRVGLPFVSLFMVLAPLLAPLIDVFLLYGLVFGPTEKTIVAWLGVLAIQAVCAAYAFRLDREKLTPLISLPLQQILYRQIMYVVLLQSWITALTGGRLRWQKLRRSGGVSAPPPGADGVPPQRRSGAMDGRPVG

SEQ ID NO: 4596 - protein, 472 aa, Thermobifida fusca
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 4597 - protein, 506 aa, Yersinia pseudotuberculosis
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAIEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 4598 - protein, 338 aa, Streptococcus agalactiae NEM316
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAVVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 4599 - protein, 483 aa, Nicotiana tabacum
MATTQNRRSSVSSATTKRQAMTSNSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 4600 - protein, 758 aa, Olea europaea
MWKLKIADGTGPWLTTTNNHIGRQHWEFDPEAGTPDERVEVERLREEFKKNRFRTKQSADLLMRMQLVKENQRVQIPPAIKIKETEGITEEAVITTLRRAISFYSTIQAHDGHWPAESAGPLFFLPPLVLALYVTGAINVVLSREHQKEITRYIYNHQNEDGGWGIHIEGHSTMFGSVLSYITLRLLGEGQEDGEDKAVARGRKWILDHGGAVGIPSWGKFWLTVLGVYEWDGCNPMPPEFWLLPNFSPIHPGKMLCYCRLVYMPMSYLYGKRFVGPITGLVLSLRQEIYTEPYHGINWNRARNTCAKEDLYYPHPLAQDMLWGFLHHFAEPVLTRWPFSKLREKALKVAMEHVHYEDMNSRYLCIGCVEKVLCLIACWVEDPNSEAYKRHIARIPDYFWVAEDGLKMQSFGCQMWDAAFAIQAILSSNLAEEYGPTLMKAHNFVKASQVQENPSGDFNEMYRHTSKGAWTFSMQDHGWQVSDCTAEGLKAALLFSQMPIELVGAEIETGHLYDAVNVILTLQSASGGFPAWEPQKAYRWLEKLNPTEFFEDVLIERDYVECTSSAVQALKLFKQLHPGHRRKEIASCISKAIQYIEATQNPDGSWDGSWGICFTYGTWFAVEGLVACGKNYHNSPTLRRACEFLLSKQLPDGGWSESYLSSSNKVYTNLEGNRSNLVQTSWALLSLIKAGQVEIDPGPIHRGIKLLVNSQMEDGDFPQEEITGAFMKNCTLNYSSYRNIFPIWALGEYRRRILHAQT

SEQ ID NO: 4601 - protein, 148 aa, Oryza sativa
PKKKKKSSRTLIHAKKLAQLARKLQQKMVSARGGRHTSSATDDCCSTSSLAGKGHCTVYTADGARFEVPLPYLGTMVFGELLMMSQEEFGFAGDDGRITLPCDASVMEYVLCLLRRDASEEVERAFLSSMARPCHNVRVFSHQLAVCT

SEQ ID NO: 4602 - protein, 391 aa, Glycine max
  unsure (1)..(391): unsure at all Xaa locations
RVRGRVVGRVGSEQAEVEERKDDEVEAVAKKNGTDESSIEDEKEELPEPVPEPPKLVRMANLCVVGGHAVNGVAEIHSEIVKDEVFNAFYKLWPEKFQNKTNGVTPRRWIRFCNPDLSKIITEWIGTEDWVLNTGKLAELRKFVDNEDLQVQWREAKRSNKVKVAAFIREKTGXXVSPDAMFDIQVKRIHEYKRQLLNIXGIVYRYKKMKEMSAAXRKAXXVPXSLYIWGGKAFATYVQAKRIVKLXTDVGAXVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKKWTRMSILNTAGSYKFSSDRTIHEYAREIWNIEPVQLP

SEQ ID NO: 4603 - protein, 90 aa, Trichodesmium erythraeum IMS101
MNLPSPDTPLYNHPLPKIEEWLQENGCQQNPEKLHCWWVEKPNWQAELLLDIDQLTIRYVNAGVDGSDIQRSFTYSLSRRDIEEAIFSGP

SEQ ID NO: 4604 - protein, 660 aa, Oryza sativa
MGPPAAPPSPSSSSGGSSRRRRRLERRNAAKHIGYDASNFCAYPQSPPAASAPASGSPSLACSPACSLDLTSFRIGGSGDGCRDVQLLCSSLGLSGVDDFAVPVADWEAHKAGRSSFSSSASTPKPREEPPARDSPVRREVAAEEEPPSLPAPAAAPVLPAKETPRSVAIEAPAPLLRVDPWEPARPDVRKASGEGGIKGVRPPPVVLKPPPSMVRPAVCVVESTWDILRSFAPEEDSHAHAPASRSGGDSACQDAGEEEDDAAAVLTLEELRLGETSEEFTGTSSLSTTNDDETSSTTTESMFYISPNGRFRRKIRSWNRGMLLGSGSFGTVFEGISDEGVFFAVKEVCLCDQGSNAQQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFNVLKSCKGTVYWMAPEVVNPKTTYGPEADIWSLGCTVLEMLTRQLPYPGLEWTQALYRIGKGEPPAIPNCLSRDARDFISQCVKPNPQDRPSAAKLLEHPFVNRSMRSIRSMRTSSRSNSSILVLLIMWSWPGRTIRYREAILSTAQSSTPTIAFHLLILSHSLLRGDMSWFSQRLIFSPENRLNVHSSA

SEQ ID NO: 4605 - protein, 237 aa, Triticum aestivum
MGGGNDGHGYPPGGQGGYPPAGYPPQQGGYPPQQGVYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGGGMGMGGMLAGGAAAAAAAYGAHKISHGSHGGGGHMMGGMMGGHGGYGGGYGHHGGKFKHGKHGHGKFKHGKHGKHGMFGGGGKFKKWE

SEQ ID NO: 4606 - protein, 334 aa, Geobacillus stearothermophilus
AVKVGINGFGRIGRNVFRAALKNPDIEVVAVNDTGGANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 4607 - protein, 453 aa, Kappaphycus alvarezii
KDTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 4608 - protein, 329 aa, Brucella suis 1330
MSLISIGPLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVACFGAGHVSGDEADIIERYASRIPVVVASRTYGGRTATKTYGFHGSEIDLQTKGAMLAGWLSPRKARLLLWALLAAGKNLEETRANFLLYNP

SEQ ID NO: 4609 - protein, 390 aa, Schizosaccharomyces pombe
KNQTHIFREMSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 4610 - protein, 341 aa, Neisseria gonorrhoeae
MGIKVAINGYGRIGRQVLRAIYDYQIQDQLQIVAVNASGSLETNAHLTKFDTIHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 4611 - protein, 380 aa, Triticum aestivum
  unsure (1)..(380): unsure at all Xaa locations
MMVRAREMVQGPRCVALLLLVCMAALVASDTTDGLLPNGNFEEAPDRSQMDGTRVTGXRYAIPRWEACGCVEYICSGQKQGDMVLPVPEGAHAVRLGNDASVQQQLSVTPGTHYAITFSAARTCAQAEKLNVTVGAQSGELPIQTVYTSSGWDSYSWAFEAKESVVTLTVHNPGYDEDAACGPVVDSFAIRTLLPPQSNEYNMLKNGDFEEGPYICPSTSCGVMVPPMDEDSYSPLFPWVILSSTKSVRYVDAAHYAVPQGARAVQLVFGAESALVQEVCTVPGVSYRMEFSIGDAADGCTGSLAVEAYAAGGRVTVPYESQGTGGFTRGVLEFTATEDRTRVVFVSASYNMKSDGTVCGPVVDDASLVCAQSHARRLLL

SEQ ID NO: 4612 - protein, 413 aa, Glycine max
MVAMAAATASTQLIFSKPRSPSRLCPFQLCVFDTKQVLSSSSGRRRHVGGSGVRCMAVGEAATTGTKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTVSLLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 4613 - protein, 439 aa, Gymnogongrus dilatatus
  unsure (1)..(439): unsure at all Xaa locations
PGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFFKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYDTLLLPXLKVNLPQGIFFEQDWASLRKVTPVASGGIHCGQMHQLLDYLGVDVVLQFGGGTIGHPDGIQAGATANRVALESMVIARNEGRDYVAEGPQILQDAAKTCGPLQTALDLWKDITFNYTSTDTADFVETPTANV

SEQ ID NO: 4614 - protein, 497 aa, Eremothecium gossypii
MSELFEEINVPETGFTYLQPLGLFIDNEFVAPMGGSQLQTTNPANGELIATFYAAGAADVDAAVAAARRAYEERWRHTSAQERGALLARLAELVDEEREVLAGIETLDSGKPYHTNALADLDQVAYVTRYYAGGADKMHQGDAFALSHTKQAYTLEVPYGVVAQIVPWNYPLAMASWKAQGCLAAGNCVVIKPSENTSLSLLYFASLVRRAGFPPGVFNVLPGLGPEVGQRLAEHKGVDKIAFTGSTAVGQKVMAAAAMSNLKDVTLECGGKSPAVIFADADLDSAVNYVAAGIFYNSGQNCTANSRIYVQEAVYDAFLDKFRAHVRSTYSFGSGLFSKDCNMGPVISKTQYDRVMGYINHGINEKLAYEQFGSVPEKGYYIPPTIFLDVPQSSRLCREEIFGPVAVVAKFKDYDEAIRYANDTNYGLASCVFTENIRVAHRFVRDVQSGTVWVNSSNDEEVGVPFGGFKMSGIGRELGKAGLQTYLQTKAVHLNFA

SEQ ID NO: 4615 - protein, 342 aa, Triticum aestivum
  unsure (1)..(342): unsure at all Xaa locations
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGXAKKVVISAPXSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTXGMSFRVPTVXDVSVVDLTVRIEKGASYEEIKKAIKAASEGPLKGIMGYVEEDLVSTDFTGDSRSSIFDAKAGIALNDHFIKLVSWYDNEWGXYSNRVVDLIRHMFKTQ

SEQ ID NO: 4616 - protein, 344 aa, Triticum aestivum
MSDTEEENPEENDEGLTGLEGELKGWRVGETFEGFTGTSSLSTTNDDDASSTNTEAVFVISPNGKFKRNIKSWMRGALLGSGSFGMVYEGISDEGAFFAVKEVSLLDQGSNAQQSILSLEQEIALLSQFEHENIVQYYGTDKEESKLYIFIELVTQGSLSSLYQKYKLRDSQVSAYTRQILNGLVYLHERNVVHRDIKCANILVHANGSVKLADFGLAKEMSKINMLRSCKGSVYWMAPEVVNPRKTYGPAADMWSLGCTVLEMLTRQIPYPNVEWTNAFFMIGKGEQPPIPSHLSAEAQDFIRQCVRVDPDERPSASQLLAHPFVNRPLRASFDSLSPPINRP

SEQ ID NO: 4617 - protein, 688 aa, Oryza sativa
  unsure (1)..(688): unsure at all Xaa locations
MAASRLVAAAAIVVVVLVLAGAGAAGAAGAGEVRALLDLAAGLDPTGRLLPSWAPGRDPCGREGGGGFEGVACDGATGAVANVSLQGKGLAGTLPPAVAGLTALTGLYLHYNRLTGALPRELAALSRLTDLYLNVNNFSGPIPPEIAAMPSLQVVQLCYNQLTGGVPTQLGLLKRLTVXELQSNHLSGAIPASLGDLPQLVRLDLSFNNLFGSIPVRLALLPRLLALDVRNNTLTGSVPSELAKLQGGFQYANNTDLCGTGLPALRPCTPADLISPDMPQPFSAGISPQITPGSSSDGHGHCTGTHCPPSTKALAAVVVVADLLAVSGAGMFAFSWYRWRKQRVVAGSPVAVGGQCSTDAAGKDSFRKSASSTLVSLEYSNGWDPLADGRGGIGFSQEVAQSFRFNMEDVESATQYFSELNILGKNGNFAATYRGTLRDGTSVVVKRLGKTCCKQEEAEFLKGLKLLAELQHENIVGLRGFCCSRARGECFLVYDFVPNGSLSQFLDIDADDVARSNGRVLEWSTRISIIRGIAKGIEYLHSTRANKPPLVHQNISADKVLVDYTYRPLISGSGLHKLLVDDLVFSTLKASAAMGYLAPEYTTTGRFSEKSDVYAFGVIVFQILTGKSKIMQLPLESSNDEDLIDGNLRGCYSAAEAAKLAKIASACTSENPDHRPTMEELIQELCTF

SEQ ID NO: 4618 - protein, 364 aa, Vibrio parahaemolyticus RIMD 2210633
MNVQALPMHRFIDHDGNLVGQLPNWADIETLVGFYRDMVLTRTYDQKAVALQRTGKLGTYPSHLGSEAIGIAVGRALKTDDVFVPYYRDMPAMWCRGIGMEKNLQYWGGDERGSDFAPEGSPIPSRDLPFCVPIATQCTHAVGVASALKIQGNHEAALVMCGDGGTSKGDFLESINCAGTWNIPLVFVVNNNQWAISVPRSLQCAAEFLSEKAKGAGIPGITVDGNDVVAMYDATMTALERARKGKGATLIEAVSYRLSDHTTADDATRYRNADDVQTAWQFEPVSRLKTFLINQGAWSDEQEQQWQSDCKEQVELAVERYLNLPQQAPETGFDYLYESLPQELHAQRDELINKAMRMQGGKHG

SEQ ID NO: 4619 - protein, 450 aa, Rhodophyllis divaricata
DILALFRVSPQPGVDPIEASAAVAGESSTATWTVVWTDLLTACDLYRAKAYKVDAVPNTSDQYLAFIAYDIDLFEEGSIANLTASIIGNVLGFKAVKALRLEDMRIPVAYLKTFQGPATGVISERERMDKFGRPFLGATVKPKLGLSGKNYGRVVYEGLKGGLDFLKDDENINSQPFMRWKERYLYSMEGVNRSVAATGEIKGHYLNVTAATMEEMYERAEFAKQLGSIIIMIDLVIGYTAIQTMGIWARKNDMILHLHRAGNSTYSRQKIHGMNFRVICKWMRMAGVDHIHAGTVVGKLEGDPAMIRGFYNTLLLPYLEVNLPQGIFFEQDWASLRKVTPVASGGIHCGQMHQLLDYLGVDVVLQFGGGTIGHPDGIQAGATANRVALESIVIARNEGRDYVAEGPQILQDAAKSCGPLQTALDLWKDITFNYTSTDTADFVETPTANV

SEQ ID NO: 4620 - protein, 104 aa, Triticum aestivum
  unsure (1)..(104): unsure at all Xaa locations
MGPTVVAWGATSVDPFQGLKSTEGLHVRRRYNGARLGSVRNGGRVRCMQVWPIEGMKKFETLFYLPPFSTGALLKQVDYLXIRSKWGPCLEVSKGGFIFREHNA

SEQ ID NO: 4621 - protein, 454 aa, Meristiella gelidium
  unsure (1)..(454): unsure at all Xaa locations
VKETDVLALFRVTPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGXXXXXXXXVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 4622 - protein, 160 aa, Zea mays
MAAAATATTPSVAPEAGDRKAVAPPVDAVDLELELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 4623 - protein, 495 aa, Shigella flexneri 2a str. 2457T
MNFHHLAYWQDKALSLAIENRLFINGEYTAAAENETFETVEPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 4624 - protein, 242 aa, Arabidopsis thaliana
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 4625 - protein, 370 aa, Agrobacterium tumefaciens str. C58 (Cereon); identical to SEQ ID NO: 301

SEQ ID NO: 4626 - protein, 89 aa, Triticum aestivum
IGSVPESIEPVKMSKHAGWGVMTTPRSGETEDTFIADLAVGLSPGQIKTGAPCRSEGFAKYNQFLRIEEELGNPPVYPALKFRAPVEPY

SEQ ID NO: 4627 - protein, 627 aa, Ipomoea batatas
MEREWFLPFKVLGLGIWMLIATSCSATLSPSGVNYEVVALIAIKTGLHDPYNVLENWDVNSVDPCSWRMVTCSPDGYVSALGLPSQSLSGTLSPGIGNLTNLQSVLLQNNAISGHIPAEIGKLERLQTLDLSNNKFNGDIPSTLGDLRNLNYLRLNNNSLSGQIPESLSKVDGLTLVDVSFNNLSGRPPKLPARTFKVIGNPLICGQSSENNCSVIYPEPLSFPPDAGKGQSDAGAKKHHVAIAFGASFGALFLIIVLVSLIWWRYRRNQQIFFDLNDNYDPEVCLGHLRRYTYKELRTATDHFNSKNILGRGGFGIVYKGSLNDGTIVAVKRLKDYNAAGGEIQFQTEVEMISLAVHRNLLRLWGFCSTENERLLVYPYMPNGSVASRLKDHVHGRPVLDWSRRKRIALGTARGLVYLHEQCDPKIIHRDVKAANILLDEDFEAVVGDFGLAKLLDHRESHVSTAVRGTVGHIAPEYLSTGQSSEKTDVFGFGILLLELITGQKAVDFGRGANQKGVILDWVKTLHQEGKLNLMVDKDLKNNFDRVELEEMVQVALLCTQFNPSHRPKMSEVLRMLEGDGLAEKWEASQRNDTPRYRTHENTPQRYSDFIEESSLIVEAMELSGPR

SEQ ID NO: 4628 - protein, 433 aa, Filobasidiella neoformans
MGGCMSTPEAPKKTAETKQVPSTSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGMRRNINKAAKYILWRFTQTNRARLSVYPHLTQATDTSNIRLVFAAVKETILQNALRDSGIL

SEQ ID NO: 4629 - protein, 538 aa, Oryza sativa
MILLASPLASPIALPPAAGVVSQSDPSLATNPPPPPPPPPLASAERGEMFIESFRVESPHVRYGAAEIESDYQYDTTELVHESHDGASRWIVRPKSVRYNFRTTTTVPKLGVMLVGWGGNNGSTLTAGVIANREGISWATKDKVQQANYYGSLTQASTIRVGSYNGEEIYAPFKSLLPMFSDLQNLFFRFLMVMKKIQVNPDDLVFGGWDISNMNLADAMTRAKVLDIDLQKQLRPYMESMVPLPGIYDPDFIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYELGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPL

SEQ ID NO: 4630 - protein, 527 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEVRLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKIVSWRTHLVFPEGARLTPEARDLICRLLCDSEHRLGSHGAGAEQIKAHTWFKDVEWEKLYEMDAAFKPVVNGELDTQNFMKFDEVECPKPARTGSGPSWKVSITPQNINFVGYTYRNFDAVRGSRHSLDIKGSVSPPRSSTDSTRSDSAIDYTKLSTGGDGSQQ

SEQ ID NO: 4631 - protein, 602 aa, Burkholderia fungorum
MTFSSGLPDRGSDSPARGRSATTVKKESSMASNTIAAYLARTLAAAGVQRIWGVTGDSLNGLAYSLDQVGSIRWMHTRHEEAAAFAAGADAASSGRLAVCAGSCGPGNLHLINGLFDCHRNHQPVLAIAAHIPSSEIGLGYFQETHPQELFKECSHYVELVSSAAQFPRVLARAMRTAVEERGVAVIVLPGDVALSEGPSEAPSWTESAPPRIVPAEADLDRLAALLNASDAVTIMCGSGTQGAHDEVVALADTLGAPVVHALRGKQFIEYDNPYDVGMTGLIGFSSGYHAMMSCDTLLLLGCDFPYRPFYPPDAKIIQIDWKGSQLGHRAPLALGLVGTVKETVAATLPKLQRKTDRGFIDNARKHYASARKGLDDLATPAGAGRPIHPQYLAKMIDESASDDAIFTADVGTPTVWAARYLTMNGKRQLHGSFNHGSMANAMPQALGAQGAHPGRQVVSLSGDGGLSMLLGDLLTARQLDLPIKVVVFNNSLLGFVSMELKAGGYLDTNVDLAKTDFAAIAKGAGIFGLRVEESEDVAGALRQVFDHPGPALLDVVTSKHELAMPPTIELAQAKGFSLYMMRAILNGRGDEIVELARTNLR

SEQ ID NO: 4632 - protein, 245 aa, Bradyrhizobium japonicum
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAVAVAAAGADTLVAGSAVFRGKSSADYAGNIAAIRVAAEAGRVSKLQDISVQPMRAGESARLR

SEQ ID NO: 4633 - protein, 449 aa, Zea mays
  unsure (1)..(449): unsure at all Xaa locations
MMAASGAYAAQLPAVPEWLNKGDNAWQLTAATLVGIQSMPGLVVLYGSIVKKKWAVNSAFMALYAYASSLLVWVLAGFRMAFGERLLPFWGKAGVALSQGYLVRRASLSATAHXATPRTEPLYPEATLVLFQFEFAAITLAGVSXQIAGQQLMRPAADRSILFPRXRLTTMVGPRLKSDRERFSPNNILLMIAGGGLLWMGWAGFNGGAPYAANIAASVAVLNTNVSAATSLLTWTCLDVIFFGKPSVIGAVQGMMTGLVCITPGAGLVQTWAAVIMGVFAGSVPWFTMMILHKKVALLTRVDDTLGVFHTHAVAGLLGGVLTGLLATPELLEIESPVPGLRGAFYGGGIRQLGKQLAGAAFVVAWNVVATSLILLAIGLLVPLRMPEDQLMIGDDAAHGEEAYALWGDGEKFDATRHDAVRVAGGMDREGSAEQRLSGMGARGVTIQL

SEQ ID NO: 4634 - protein, 480 aa, Oryza sativa (japonica cultivar-group)
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 4635 - protein, 628 aa, Corynebacterium glutamicum ATCC 13032
MLNRMKSARPKSVAPKSGQALLTLGALGVVFGDIGTSPLYSLHTAFSMQHNKVEVTQENVYGIISMVLWTITLIVTVKYVMLVTRADNQGQGGILALVALLKNRGHWGKFVAVAGMLGAALFYGDVVITPAISVLSATEGLTVISPSFERFILPVSLAVLIAIFAIQPLGTEKVGKAFGPIMLLWFVTLAGLGIPQIIGHPEILQSLSPHWALRLIVAEPFQAFVLLGAVVLTVTGAEALYADMGHFGARPIRVAWFCVVMPALILTYLGQGALVINQPEAVRNPMFYLAPEGLRIPLVILATIATVIASQAVISGAYSLTKQAVNLKLLPRMVIRHTSRKEEGQIYMPLVNGLLFVSVMVVVLVFRSSESLASAYGLAVTGTLVLVSVLYLIYVHTTWWKTALFIVLIGIPEVLLFASNTTKIHDGGWLPLLIAAVLIVVMRTWEWGSDRVNQERAELELPMDKFLEKLDQPHNIGLRKVAEVAVFPHGTSDTVPLSLVRCVKDLKLLYREIVIVRIVQEHVPHVPPEERAEMEVLHHAPIRVVRVDLHLGYFDEQNLPEHLHAIDPTWDNATYFLSALTLRSRLPGKIAGWRDRLYLSMERNQASRTESFKLQPSKTITVGTELHL

SEQ ID NO: 4636 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 4637 - protein, 247 aa, Houttuynia cordata
MGRGRVELKRIENKINRQVTFSKRRNGLLKKAYELSVLCDAEVALIIFSNRGKLYEFCSSSSMMTTLERYQECSYSMPEATGPTRETEKSYQEYLKLKGKVELLQRTQRNLLGEDLGPLSSKELEQLENQLEHSLRQIRSTKTQALLDQLSDLRRKEQQMLESNKILKKKLAEHGPENLLQLAWQSCGQSNPYSRQPAHSEAFFQPLDCNPTLQIGYHPVGQEEITMAAPAIAPPQNVNGFIPGWMV

SEQ ID NO: 4638 - protein, 388 aa, Pyrenomonas salina
MYKTVLVGVLSVAAGANAFQMGSSFVPRMGGQAETARRATMTGPVMAEDPVKCGINGFGRIGRLVARIMIKDPETNLIHVNAGSATPDYMAYQFKYDSIHGRFDGAVVVDGEDLVIDGQRVITTRQRDPKDIGWDKTGVEYLCESTGVFLTSEKAQAHIDGGCKKVIFSAPAKDDSLTVVMGVNPDDYKGQTDFVSCASCTTNGLAPLVKCINDKFGIEEGLMTTIHAMTATQAVVDSSSRKDWRGGRAASGNIIPSSTGAAKAVAKVIPDVKGKLTGMAFRVPTIDVSVVDLTCKLKKETTYEEICNEVKKRAAGDMKGVLGYCDEPLVSTDFESESISSTFDAEAGIMLNPSFVKLVAWYDNEWGYSTRVKDLMVHMAKVDAKVSA

SEQ ID NO: 4639 - protein, 375 aa, Oryza sativa (japonica cultivar-group)
MWGLGLVKPMEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPPEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEAPGFWNSSMIGNGSSNGGGGGGSW

SEQ ID NO: 4640 - protein, 151 aa, Triticum aestivum
RWKGLDDSGVELDDGLSGLQTEVENLNLQEQALDERISDMREKLRGLTEDENSQRWLYVTEDDIKGLPCFQNETLIAIKAPHGTTLEVPDPDEAGDYLQRRYRIVLRSTLCPIDVYLVSQYDDGFENLCGAATPARHTNVPKSGPCEDLHA

SEQ ID NO: 4641 - protein, 420 aa, Grateloupia catenata
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVMARNEGRDYVAEGPQILQDAAKTWA

SEQ ID NO: 4642 - protein, 598 aa, Oryza sativa
MALRPNDVTLRLTPPLAAAARRNRRAAAGGVRVYAVASGAVSTKDFRCTCPRIGAAIRGSSTLRHECVSLLPRIRFFFSSFCLPRLGFVSNSAPSPFLVAGFGTGARNPCTLEPYSPLIYRCTAQGKSVVHNSIDLKNLFRGASMGTPRRSYRCQPDLVARGPQHGDVARSVMEFNLICSSLSHLIQYGIGRRVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKAGKFNSEHQTPLRLLRAPVLLLSVLVETHFENNTSELHRTTDKPRLFGATVMSADKQHTIQQSVHSVIF

SEQ ID NO: 4643 - protein, 161 aa, Oryza sativa (japonica cultivar-group)
MASRAELPLKQVPRNFRLLEELERGEKGIGDGTVSYGMDDADDIYMRSWTGTIIGPPNTVHEGRIYQLKLFCDTDYPDRPPTVRFQTRINMSCVNQETGMVEPSLFPMLGNWQREHTMQDILIGLKKEMSAPQNRRLHQPHDGNEDQRVEQKGLSLRCVIM

SEQ ID NO: 4644 - protein, 379 aa, Streptococcus agalactiae 2603V/R
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 4645 - protein, 319 aa, Rhodobacter sphaeroides
MQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 4646 - protein, 137 aa, Saccharomyces cerevisiae
MSKVPRNFRLLEELEKGEKGFGPESCSYGLADSDDITMTKWNGTILGPPHSNHENRIYSLSIDCGPNYPDSPPKVTFISKINLPCVNPTTGEVQTDFHTLRDWKRAYTMETLLLDLRKEMATPANKKLRQPKEGETF

SEQ ID NO: 4647 - protein, 41 aa, Aegilops longissima
KGKLPKDARLALVDWWNTHYRWPYPTINNWFVNQRKRHWKP

SEQ ID NO: 4648 - protein, 336 aa, Streptococcus uberis
MVVKVGINGFGRIGRLAFRRIQNVEGVEVTRINDLTDPNMLAHLLKYDTTQGRFDGTVEVKDGGFEVNGNFIKVSAEKDPENIDWATDGVEIVLEATGFFAKKAAAEKHLHANGAKKVVITAPGGDDVKTVVFNTNHDILDGTETVISGASCTTNCLAPMAKALQDNFGVKQGLMTTIHAYTGDQMILDGPHRGGDLRRARAGASNIVPNSTGAAKAIGLVIPELNGKLDGAAQRVPVPTGSVTELVAVLEKETSVEEINAAMKAAANDSYGYTEDPIVSSDIIGMAYGSLFDATQTKVQTVDGNQLVKVVSWYDNEMSYTAQLVRTLEYFAKIAK

SEQ ID NO: 4649 - protein, 553 aa, Candida albicans
MGIASILSNKNITINVDHVIDSDEAMLLAIGYRQELRREFSLWSIFAVSFSVLGLLPSIAACFDYQQLVVGMSPLPWLIAMIFITSVAYSMAEIASAFPCSAGTPYAVSQLAPKKYASFLTWFTCWTNWSCQITAAPSVSYSCACMMLALHSFTDPSFVASNAQIFGLTTGIQVLCAFMACFPTKWVARFSSAGTTCNIVFLVVVFIMILGGNKRDQIKEGISKFNSNSTAWGLDNQAEWPTGLSFLISFMGVIWAMSGYDSPFHLAEKCSNAAVAAPRAIVLTSTVGGLIGFMFMIAIAYTLVDLNQISADPESLGQPFVTYLTQIMDKNLVIGATALTIISSFFMAQNCLLASSRVTYAYARDGLFPLSGIWKKVSPKTQTPINAVIMNFIVEELLLLLIFGGDVSIGSIFSIGALAGFISFTMPTLLKITYARKTFQPGPWNLGKWSEPIGWVSVAFVGLMVPILCFPTVKGADLTPTEMNWTCLVYFGLILLTTIWFVVYARRWYVGPRTNISEEDIVYGEKTEDEGDEIPDVIDGQKVSISSTEKRYQ

SEQ ID NO: 4650 - protein, 222 aa, Tradescantia virginiana
  unsure (1)..(222): unsure at all Xaa locations
GLVKKAHEISXLCDAEVALIIFSTKGKLYEYATDSKMENILERYERYSYAEKALTSSDPELQGNWCQEYVKLKAKVEALHKSQRHLMGEQLEALDLKELQQLEHQLEGSLRLVRSRKTQMMLDSISELQRKEKSLEEQNKNLEKEILEKQKEKALAHQAHWEQQNQPLQSTNSPPRPFVIAETHPTLNIGNFQGRTNTVHAEESLQRQMRISSSLLPXWMXH

SEQ ID NO: 4651 - protein, 335 aa, Staphylococcus warneri
MAVKVAINGFGRIGRLAFRRIQDVEGLEVVAVNDLTDDDMLAHLLKYDTMQGRFTGEVEVIDGGFRVNGKEVKSFDEPDASKLPWKDLDIDVVLECTGFYTDKDKAQAHDDAGAKKVLISAPATGDLKTIVYNTNHDELDGSETVVSGASCTTNSLAPVAKVLSDEFGLVEGLMTTIHAYTGDQNTQDAPHRKGDKRRARAAAENIIPNSTGAAKAIGKVIPEIDGKLDGGAQRVPVATGSLTELTVVLEKDVTVEQVNEAMKQASDESFGYTEDEIVSSDVVGMTYGSLFDATQTRVMAVGGRQLVKVAAWYDNEMSYTAQLVRTLNKLAELSK

SEQ ID NO: 4652 - protein, 247 aa, Petunia integrifolia subsp. inflata
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 4653 - protein, 323 aa, Triticum aestivum
MSSALDQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATWEGIKAAEILQRDHGINTNLTLMFSLVQAIGAAEAGAYLISPFVGRILDWFKASTKKEYTKEEDPGVLSVKQIFNYYKKFGYNTIVMGASFRNTGEITELAGCDYLTISPNLLEDLLNSSDSVPKKLDASQASSLDIEKKSYIKDEALFRFDFNEDQMAVEKLREGISKFAPVAVTLKGILKEKLS

SEQ ID NO: 4654 - protein, 336 aa, Pseudomonas fluorescens PfO-1
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 4655 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 4656 - protein, 842 aa, Pseudomonas syringae pv. tomato str. DC3000
MSIYRMEHSLDMNKKISDAPIWPVNSFKSVVTKVPDWPDSISGLAYNPFRPGQSPYKHIYPTREQIKEDLLLIRPLTRHVRTYSVEQTLACIPEIAEELGMSVTLGIWIGWDEKRNDRELIEGVKLANQYPSVRRLIIGNETLLRNDVTVSQLIDYMQTARQGVNVPISTSEGWQQWHDTPELADHADFIAAHVLPFREFVPVTQAGSAVLARANELRLMFPEKPLILSEIGWPDKGNFRRRTTAYVAEQSIYLRSQLALLNQSGLDYFVREAFDQQWKTEEGLPGPHWGLFDAQRKIKLPLQGPVKIRASWRSEVPRLVADWQPDNWRTTVLIFAALYTLLVGVGISYAQPLSMWVALPIALVWVTSLLIGTGIQGYEFLESCWGPEKPRSFPPLRAYPGPLPKVSIHVPCYNEPPDMVKLTLDALQRLDYPNFEVLIIDNNTQDPEVWEPIEQYCRQLGPRFRLFHVNPLSGFKSGALNYLLDYTAKDAEIVAAIDADYCVHRHWLKHMAPYFACPDIAVIQVPQDYRDGDDSLFKRCCQAEYRVFFNIGMVIRNDHDAIIQHGTMTLIRNSVLQRLRWAEWSICEDAELGLRILENGFSTGYVAISYGKGLIPDTFMDFKKQRYRWAYGVIQILKRHTGSLIAGTCEALTPIQRYHFIAGWMPWIAGGINYFLAIAVLLWSMAMIIQPDTLEPVPWIFSSSLLLMFVLGVCKAISLYQRLASTDIKDAFAAIIASMALYSVVGKAVLSSAFTSGLPFFRTPKQTSGSGLGKALLDVREDLYMAVVWWVMTVSLCFRKEAIGPDLGFWVAIMFAQSLPYVAAMIMAILSALANRPSRSTT

SEQ ID NO: 4657 - protein, 304 aa, Emericella nidulans
MAATNGASNDFTVKAGLAQMLKGGVIMDVVNAEQARIAEEAGAAAVMALERVPADIRAQGGVARMSDPSMIKEIMEAVTIPVMAKARIGHFVECQILEAIGVDYIDESEVLTPADNLYHVTKHNFKAPFVCGCRNLGEALRRISEGAAMIRTKGEAGTGDVVEAVKHMRTVNAEIARARAILQSSPDPEPELRAYARELEAPYELLREAAEKGRLPVVNFAAGGVATPADAALMMQLGCDGVFVGSGIFKSGDAKKRAKAIVQAVTHYKDPKVLAEVSQGLGEAMVGINVSHMKDEDKLAKRGW

SEQ ID NO: 4658 - protein, 306 aa, Escherichia coli CFT073
MKFRGGRMSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHATRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFFGAVLIMTGLYINVFGLRWRKAVKVRG

SEQ ID NO: 4659 - protein, 189 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 4660 - protein, 357 aa, Pinus taeda
MGSLESEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHMGVKIAKAFGLHVTVISSSDKKKEEAMEVLGADAYLVSKDTEKMMEAAESLDYIMDTIPVAHPLEPYLALLKTNGKLVMLGVVPEPLHFVTPLLILGRRSIAGSFIGSMEETQETLDFCAEKKVSSMIEVVGLDYINTAMKRLEKNDVRYRFVVDVAASKLDN

SEQ ID NO: 4661 - protein, 256 aa, Glycine max; identical to SEQ ID NO: 1852

SEQ ID NO: 4662 - protein, 321 aa, Streptococcus pyogenes MGAS8232
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLITLGIPVVLVSRCFNGMAEPVYAYEGGGAMLQEAGVMFVKELNAPKARLKLLIALNAGLTGQELKDYIEG

SEQ ID NO: 4663 - protein, 447 aa, Glycine max
  unsure (1)..(447): unsure at all Xaa locations
MGQGTPGGLNRQGLPGDRKPDGGDKKEKKFEPAAPPARVGRKQRKQKGPEAAARLPTVTPLSKCKLRLLKLERIKDYLLMEEEFVANQERLKPQEEKAEEDRSKVDDLRGSPMSVGNLEELIDENHAIVSSSVGPEYYVGILSFVDKDQLEPGCAILMHNKVLSVVGLLQDEVDPMVSVMKVEKAPLESYADIGGLDAQIQEIKEAVELPLTHPELYEDIGIKPPKGXVILYGEPGTGKTLLAKAVANSTSATFLRVVGSELIQKYLGDGPKLVRELFRVADDLSPSIVFIDEIDAVGTKRYDAHSGGEREIQRTMLELLNQLDXFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 4664 - protein, 241 aa, Nostoc sp. PCC 7120
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 4665 - protein, 159 aa, Buchnera aphidicola
MANILLLDNIDSFTYNLVDQLRKHKNNVIVYRNTVDINIISHALIQLTNPILMLSPGPGLPRDAGCMSSLIKIVKGQIPMIGICLGHQAIVEAYGGQIKYAGEIFHGKVSSISHDGLEMFKNVPQYLPVARYHSLICSDVPKDLIINSTFNQMIMSVRH

SEQ ID NO: 4666 - protein, 303 aa, ASPERGILLUS NIDULANS FGSC A4
MEETRVNLLEYLRSKTQVDLDTFDITGISFPRLLEHTLNLETVAAGLHDQFPEVTFDELGVEVGAVLLAGEMVPAFTGNLHLMVNPSYAYSREKVIEAAKSTPSPISLYPVLPATWEGLQACRDLQAFKIKTLGTTLFSMEQAILAGEAGCVSISPFVHSLRILVDPEYKDPHPVYNLSAQAQRWYRRQSLPTKVKSCSTVGVDELLELAGIDALTIIPDDLRALQSTYRDANQVFKLSIVENGTQNDDKIEHISYINDEEKYRADFQKADEGRAKAKTAEAIDIFCGFQAKAEDVIRKAKGQ

SEQ ID NO: 4667 - protein, 460 aa, Phycodrys rubens
WDPEYVIKETDILALFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAASGEVKGHYMNVTAATMEEIYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPELELNLPLGIFFKQDWASLRKVTPVASGGIHCGQMHQLLDYLGDDVVLQFGGGTIGHPDGIQAGATANRVALESMVVARNEGRPFVEEGLQILRDAAKTCGPLQTALDLWKDITFNYTSTDTADFVETPTANV

SEQ ID NO: 4668 - protein, 438 aa, Mazzaella cornucopiae
NERYESGVIPYAKMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFGTDWASLRKVTPVASGGIHCGQMHQLLDYLGVDVVLQFGGGTIGHPDGIQAGATANRVALESMVIARNEGRDFVAEGPQILQD

SEQ ID NO: 4669 - protein, 320 aa, Arabidopsis thaliana
MGGNETRELPIINLSDKNLKQNTELWSFTRDSVREAMEHHGWFVAEYNNFPTGLHQSILEAAKELLDLPVEIKLKNENHKAGHGYITMMSDGQPVHEGLGIDQVNDVQQCRGFSRLMWPDDHDDNDRFCETVHAYAKMQAELEQLVIRMLFESYNVEKYTEKYIGGTRYLLRLLKYRRLPNGEPNRKFISHTDKSFISILHQNHITGLMLKSEKEDVWYHFTPSPTRFVVIAGDAIMAWSNDRIKACYHKVEMESVEMRYSLGFFSFQEGMISTPEEMVDKDHPLAYNPFHHDGLLEYYETLEVHLKAHRTMTKAYCGIP

SEQ ID NO: 4670 - protein, 469 aa, Brucella suis 1330
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEVRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 4671 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 4672 - protein, 456 aa, GIBBERELLA ZEAE PH-1
MSSKSRWADTEEDARLDAKLKEEKRRKKAEKARKLEEEKKLQDTAKQSNLEADDDRPSKRRRITPEPGAKQDEKLPPAKLLRFPTGSWGKSRSVENYEKLNDIEEGTYGWVARATNKATGKVVALKRLKLEPQDRNGLPVTGLREIQILKDCQHRNIVTMEEVVVGDDVSRPDNSLFLVLEFVEHDLKSILEDMPEPFLSSEVKRLLLQLTSGIAYLHDNWILHRDLKTSNLLLNNRGQLKIADFGMARYVGDPPPKLTQLVVTLWYRAPELLLGAKTYDAAVDMWSVGCIFGELLTREPLLQGKNEVDQVSRIFELCGVPTEETWPGFRRLPNARSLRLPKTQVATGSVVRARFPSLTSAGAGLLGDLLSLNPERRPSAQEMLQNEYFRQDPKPKPESMFPTFPSKANQERRRRVEPHAPVRGGQAASLGDADLSGIFQGRDKEEKGAGFQLRMI

SEQ ID NO: 4673 - protein, 342 aa, Eremothecium gossypii
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 4674 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDEYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLECCRRMVRLHQKAGTDKLTGVHRKYSSSKFGYIATKYEAAHFLVSDSH

SEQ ID NO: 4675 - protein, 472 aa, Pseudomonas aeruginosa UCBPP-PA14
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLANVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 4676 - protein, 430 aa, Grateloupia elliptica
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPFKQVLDLWE

SEQ ID NO: 4677 - protein, 182 aa, Mesembryanthemum crystallinum
MASSMVSSAAVATVNRTPAQASMVAPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 4678 - protein, 264 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLTKQLIEDYDCTHASTIAVMRVPHEEVSNYGVIAPQGKAVKGLYSVETFVEKPSPDEAPSDLAIIGRYLLTPEIFAILENQAPGAGNEVQLTDAIDKLNKTQRVFAREFKGERYDVGDKFG

SEQ ID NO: 4679 - protein, 285 aa, Neurospora crassa
MDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAGTATGGVAAGGEGVH

SEQ ID NO: 4680 - protein, 291 aa, Streptomyces coelicolor A3(2)
MELGLVGLGKMGGNMRERIRRAGHTVVGYDRNPDLADVHSLEELVGKLSAPRVVWVMVPAGEATQATVDRLGELLEPGDVVVDGGNSRWTDDEKHAEELAAKGIGFVDCGVSGGVWGLENGYALMYGGDAENVAKVQPVFDALKPEGDFGAVHAGKVGAGHFAKMVHNGIEYAMMQAYAEGWELLEKVDSVENVREVFRSWQEGTVIRSWLLDLAVNALDDDEHLDGLRGYAQDSGEGRWTVEAAIDNAVPLPAITASLFARFASRQDDSPQMKMIAALRNQFGGHAVEKK

SEQ ID NO: 4681 - protein, 344 aa, Burkholderia fungorum
MNAKARESIPATLIPGDGIGPEVTQATVRVLEALGAPFKWDIQQAGMAGIDECGDALPQATLDSIRETKLALKGPLTTPIGGGFRSANVRLREAFELHANIRPVRTIVPGRYDDIDIVLVRENIQGLYVAHEHYIPIGDDPRAVAVLTGMNTREGGRRIARCAFDYALRHGRRKITVVHKANVLKALTGIFLEAAREVAADYAGRVALDDRIVDACAMQLVLNPWQFDMLLCTNLFGDILSDQLAGLVGGLGLAPGANIGKDTALFEAVHGSAPDIAGRGIANPVSQLLAAGLMLDHVGLDEDAKRLRRAIADTLNEDKVRTPDLGGQATTRTFTDALIERLGH

SEQ ID NO: 4682 - protein, 714 aa, Paenibacillus macerans
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGALYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 4683 - protein, 98 aa, Buchnera aphidicola
LPSASLNDSNFGLYEPAGGSAPDIAGKNIANPIAQILSIAMLVRYTMKLPIISDQIESAVIDTLKKGYRTLDIANDKEKCESTNDIGDIISYILKKRI

SEQ ID NO: 4684 - protein, 431 aa, Bifidobacterium longum NCC2705
MGAIDSGNTAWILTSASLVFLMTPGVAFFYGGMVRAKAVLNMLMLEAAALSVTMIVWTLWGWSIAYAGSDIGGIFGDPASGFLLKDSMVAQDGVFTATGLNGNNYPVSVDVAFQVAFAMITVGLICGAIAERVKYSTWMIFVALWVTFDYAPMAHMVWNGGLLSADGAISKAIGAAAHDFAGGTVVHINAAVAALIIVLIIGKRKGFGTQPFRPHNVPFVMLGAFLLWFGWFGFNAGSAFAANGTAGYAWVSTSAATAAAMLSWGFTEKIRSGHYTAMGAASGMVAGLVAITPAADVVSPLWAIVMGAIAGVLTCLACGLKFKFGYDDSLDVVGVHGVGGFTGTILIGFFGEGTGLLAGGDWKQLVVQLVIALVAILYSAVITAIIAFALEKTIGWRVTEAQEVGGIDLADQGERAYDFAGTASSVLKEVK

SEQ ID NO: 4685 - protein, 501 aa, Emericella nidulans
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTGQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 4686 - protein, 488 aa, Listeria seeligeri
MTDRRNLTTNQGVPIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEEGKTVYVKLRWVPKAGIVNLSTDQAAQIQAKEFNHASRDLYEAIENGDYPEWDLYVQVLDPKDLDNYDFNPLDATKDWFEDVFPYEHVGTMTLNRNPDNIFAETESVGFNPGVLVPGMLPSEDRLLQGRLFSYSDTQRHRVGPNYLQLPINSPKTPVDNNQRDGQMPFKQQTSSINYEPNSYDTEPKENPAYIEPEQEIRGDISGRLVAEKPNNFGHAKEVWKRYSDAERAALVKNIVDDWEGVREDIKIRNLRNFYQVEPEFAERVAAGTGINLAEHVIDLK

SEQ ID NO: 4687 - protein, 413 aa, Trichoderma atroviride
MADLQGRKVFKVFNQDFVVDERYTVTKELGQGAYGIVCAAVNGQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAMDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGDMRKMILDEVLRFRQLVRTAPASGNQAAAQQIQVPMPQAGGQWTAEDPRPQEYMGHANGLEQDLAAGMDIRR

SEQ ID NO: 4688 - protein, 199 aa, Glycine max
EIKVPPFTSANEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 4689 - protein, 295 aa, Zea mays
MAGLSLEHPWAFTFGLLGNVISFMTFLAPIPTFYRIYKSKSTEGFQSVPYVVALFSAMLWIFYALIKSNETFLITINAAGCVIETVYVVMYFVYATKKGRMFTAKIMLLLNVGAFGSILLLTLLLFKGDKRVVMLGWICVGFSVSVFVAPLSIMRRVIQTKSVEYMPFSLSLSLTLSAVVWFLYGLLIKDKYVALPNILGFTFGVVQMVLYVVYMNKTPLPVADGKAAGKLPSAADEHVVVNVTKLSPGRLPPVTQMAAVPTKSCATEAAAPATLPSRDVVDVLVNRHSPAVHVA

SEQ ID NO: 4690 - protein, 187 aa, Zea mays
  unsure (1)..(187): unsure at all Xaa locations
ITMDPTKFRPSSSHDTTVTTTNAGAPVWNDNEALTVGPRGPILLEDYHLIEKVAHFARECIPERVVHARGASAKGFFECIHDPTSLTCANFXLRAPGVRTSVIARFSTVXIHDRGSPENNPRPRAGFAGKFYTPRGXWNLLANNFPVFFLRYRLQFPPKGFRGSKPQPRGSHGARRNGRGDSNFPDR

SEQ ID NO: 4691 - protein, 173 aa, Flaveria pringlei
  unsure (1)..(173): unsure at all Xaa locations
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 4692 - protein, 62 aa, Glycine max
  unsure (1)..(62): unsure at all Xaa locations
MAAGVSAAMNELRPCAPISLKHVLAQELIKGLQAVSDSLLLYNTTRVLRSNESXLFLSLCWA

SEQ ID NO: 4693 - protein, 430 aa, Magnetospirillum magnetotacticum
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVSQIAGSIGTALLLRHGLGWNLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHPFRELVSRLYGDEARTARRARTLVRRGSWRDDHNAGPGTGI

SEQ ID NO: 4694 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 4695 - protein, 139 aa, Glycine max
  unsure (1)..(139): unsure at all Xaa locations
VLLSLNVPLYKHIANIAGTKKLVLPVPAFHVINGAPHAGNKLAMQEFMVLPVGTSLFFFSLKXGVEVYHNXXPLIKKXYGQDAANGGDEGGFCPKLPQNQRNACELVQHRPSPKPGTTGQRLSFGTWLAAGFLNFNHGR

SEQ ID NO: 4696 - protein, 461 aa, Desulfovibrio desulfuricans G20
MHAPVSSPRHPAKRFARTAALWLVVATLLHASPALAEDAPAMLSQQHGNILWTLIAAILVMLMQAGFAMVECGFTRAKNAGNILMKNFVDFAAGSLVFFLVGYAFMFGADAGGFIGTSGFALAHVDPATEGGMWDLTFWFFQSVFAATAATIVSGGIAERTRFASYIIVSVLVTGIIYPVSGHWAWGGLAGNAGWLEGLGFADFAGSTVVHSVGGWVALAGAIVVGPRAGKYGPDGSVRAIPGHNIPLAALGVFILWFGWFGFNPGSTTTADGTIGYIAVNTSLAACAGTVTAMLTAWIRFGKPDASITMNGALAGLVGITAGCYELSPSGAIIVGIICGFVVVLSIEFLDKILKIDDPVGAVSVHGVCGAIGTLMVGLLAHPSYGGSTGLVYGGDASLLMVQALGVAVVFAWAFGMGLVVFRIVAAVAGLRVSPEEELKGLDITEHGSESYNGFQIFTVE

SEQ ID NO: 4697 - protein, 66 aa, Zea mays
SKSYREADDQLLLQLEEKDVISSAATILSDLCGPQEWISMNKLHEVVRKFFLMEKYHSRPRDEILQ

SEQ ID NO: 4698 - protein, 340 aa, Brucella suis 1330
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 4699 - protein, 339 aa, Escherichia coli K12
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 4700 - protein, 304 aa, Saccharomyces kluyveri
MAEKKQSNFAIDFLMGGVSAAVSKTAAAPIERVKLLIQNQDEMIKQGSLDRRYNGIVDCFKRTSEAEGVVSFWRGNTANVIRYFPTQALNFAFKDKIKAMFGFKKEEGYAKWFAGNLASGGLAGGLSLMFVYSLDYARTRLAADSKSAKKGGERQFNGLVDVYKKTLASDGVAGLYRGFLPSVVGIVVYRGLYFGLYDSLKPLLLTGTLEGSFFASFLLGWAVTTGASTASYPLDTVRRRMMMTSGQAVKYDGAFDAFRKIVAAEGIKSLFKGCGANILRGVAGAGVISMYDQLQMILFGKKFK

SEQ ID NO: 4701 - protein, 1147 aa, Schizosaccharomyces pombe
MSFLFKRNKGSAHKPTKPNFSKTSTTPSTSQLKHSHESNVKMSTSTVTEHRKKPTGSGSHITASPWSKLTVRGSSNVLPRYSHASHLYAEGGQEIYIFGGVASDSQPKNDLWVLNLATSQFTSLRSLGETPSPRLGHASILIGNAFIVFGGLTNHDVADRQDNSLYLLNTSSLVWQKANASGARPSGRYGHTISCLGSKICLFGGRLLDYYFNDLVCFDLNNLNTSDSRWELASVVNDPPPARAGHVAFTFSDKLYIFGGTDGANFFNDLWCYHPKQSAWSKVETFGVAPNPRAGHAASVVEGILYVFGGRASDGTFLNDLYAFRLSSKHWYKLSDLPFTPSPRSSHTLSCSGLTLVLIGGKQGKGASDSNVYMLDTSRFRLGSVPTTSGRQRNTSFFSNSTGNTNPSAFNGLLTSSRIPSYNGSKVRSTSHPSRQQYIGSSNSRFNTRHQTISTPVSGRASNDLPSPVVPTRSNSSSILQPSYNLNSHSSDRRNTNDDDQSSLNSQQLSNQAKAQGEVSPTLSFVPSSHSMEQGNGSVASANNAQSEAATRSINSISEVSEVRFPEQSSVKTVDERKSLDGRITSVTLETLVEKYSELSKQQIVEWFKSKLYEILRDSASKIDSLTEKLKVANAEKNAALCEAALEKVPLAKHNKLSDGTFSTPDKENVQSTNDAHIMQENFSLHKALEVMRETSSDLDKQLKDATASQKELIVQTSSFQKELVEERERHNAISKRLQEIESLYRDRELLVTNLEDQLVDQTVTINKFAFERDQFRERSMGFENTIKDLTRKMEATDMLNVSLHESLRSVQTENSELVTEMALLKAELVKKQAIIDANANIYDKLTADHTNYETVSADINQNLKETLDKLLNGSSDFKNNEIELLHDQIRITNAKLEKREKLINASKYIEDTLRSEIQEAAEKVSNLEFSNFNLKEENSNMQLQLMKALEQRNTGAKQLVNLRMQLSTATSELDMLKLKLRTTALALEESPDDYSDILSILRADMSPFHDLHKQCGVLIDTLNGVKRGFGIFEKKFTDYHKFLENISDKLKSEEDTSLETPIHENQSIQSDQIKEVGEVLSAIKSLSDSVMLLKNQIDDLAKEKLPLSSSDDEKVNIKEKTDFMKLLVKSGLSNPPAKEPVHDNEN

SEQ ID NO: 4702 - protein, 301 aa, Glycine max
MSSRVWCVVMVSALALMLQWHEAFSSYAGSASAIIDPSKVKQVSWKPRAFVYEGFLTELECDHLISIAKSELKRSAVADNLSGESKLSEVRTSSGMFIPKNKDLIVAGIEDKISSWTFLPKENGEDIQVLRYEHGQKYDPHYDYFADKVNIARGGHRVATVLMYLTDVTKGGETVFPNAEESPRHRGSETKEDLSECAQKGIAVKPRRGDALLFFSLYPNAIPDTMSLHAGCPVIEGEKWSATKWIHVDSFDKVVGDGGDCNDKHENCERWATLGECTSNPEYMVGSPGLPGYCMKSCKEC

SEQ ID NO: 4703 - protein, 552 aa, Oryza sativa
MKVDGSALAGRALAAAGARHMFGVVGIPVTSLASRAAAAGVRFLAFRNEQSAGYAAAAYGFLTGSPGLLLTVSGPGCVHGLAGLSHATANAWPLLMVSGSCSQPDAGRGDFQELDQIAATKPFIKIAVKATTIADIPRLVFQALAATVSGRPGGCYLDIPSDVLHQTLTESEAAALIDAAAADSAKSDSSPPKHKSLDEGIEKAAELLRRAERPLVVFGKGAAYSRAEDAIWKLVDTTGIPFLPTPMGKGVVPDTHPLSATAARSLAIGQCDVALVVGARLNWLLHFGEPPKWSKDVKFILVDVCEEEIELRKPHVGIVGDAKRVVELINREIKDQPFCLAPSHPWVEAITKKARDNVLKMEAQLAKDVVPFNFLTPLRIIRDAILAEGNPAPVVVSEGANTMDVGRAVLVQNEPRTRLDAAAVAEPDRLVVAVEGDSGFGFSAMEVETLVRYQLPVVVIVFNNNGVYGGDRRSPDEITGPYKDDPAPTSFVPAAGYHKMMEAFGGKGYLVETPDELKSALSESFRARKPAVINVIIDPYAGAESGRMQHKN

SEQ ID NO: 4704 - protein, 459 aa, Burkholderia fungorum
MCRPRGLRGYVTMCFISLPRGYIPMRIHALADRRTILRIRRLWLHYGIFWLGAVATGLVAVMYAKLIDFGYDTFLRYTTSHRWLPLLLTPAVAALGVWITRRWFVGAEGSGIPQVIATLHEGRELGPRLLSMRILIGKIGVSFLSILGGLTIGREGPTIHVGAALMFSLRRFYPARFRSIRGAALERNLALAGAAAGLSAAFNAPLAGVVFAIEELTRSFEQRTSGVLITAIIFAGVVSLGLQGNYTYFGTIDIDGHFPDMLAIAAVMLGVVTGVAGGAFCWLLLNTNRWMPARLVVWRKDHPVAFGAACGLVIALIGVAAGGHTFGSGYAEARGMLEGNSQLGASYPILKMASMVGSYLPGAPGGLFAPSLAIGAGIGNALHLVFGQMQLPMLIALGMVGYLAAVTQSPITAFVIVIEMINGHALVLSLMTTALIASQVSRLFAPPLYEALSKRYVAG

SEQ ID NO: 4705 - protein, 303 aa, Brucella suis 1330
MGFYGLSRRPDVGQTTRVSFEFFPPKTEEMEQRLWETVTRLAPLQPDFVSVTYGAGGSTRERTVRTVARILKETDIKPAAHLTCVDATCEDVDRVAREFAALGVNRFVALRGDPANGIGEKYVPTPGGYQNGAELVGGLRNIADFDISVSAYPEKHPESPDFATDIDMLKRKVDNGATRAITQFFFENDLYERYVERVRRAGIYIPIVPGVLPVHNFKQVRNFCARSATHIPAWLAERFDGLDNDPQTHQLVAAAIAAEQVMDLIERGVQDFHFYTMNRADLPFAICHMIGIRPKTQAALEVA

SEQ ID NO: 4706 - protein, 154 aa, Vibrio vulnificus
MHKKSSTLIRKREISDVTKESKVVLKSDQQWREQLSEQEYHVCREQGTEPPFSGKLLHNKDSGEYACTCCHAPLFSSVNKYDSGCGWPSFDAPINETAVLYLDDFSHGMKRVEIRCARCDSHLGHVFPDGPKTTGERFCVNSVSLIFNKIETNE

SEQ ID NO: 4707 - protein, 175 aa, Triticum aestivum
  unsure (1)..(175): unsure at all Xaa locations
MAPAVMASSATTVAPFQGLKSTAGLPVSRRSSGSLGSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4708 - protein, 405 aa, Magnetococcus sp. MC-1
MNPEMARLNPYPFEKLAVLFEGITPNGALSPLNISIGEPKHPTPAFVTQRMMEALQDGDMAKYPTTRGERALRESMAAWLTRRFELQAGSVDPDRHVLSANGTREAIFSVALAVVDRAKGGVVLTPNPFYQIYEGACFMAGVEPVHIDATEETHLRPPFTQLDAELLARTQMVYLCSPSNPTGAVHPLEELQELIRLADTYDFVICADECYSEIWYDAPPPGLLQACAAMGRHDFARCLVFHSLSKRSNMPGARTGFIAGDAQLLDHYFKLRTYTGCATPPFIQKAAIAAWDDEQHVEENRRAYRAKLEESMAILSPVLPVTRPEASFYLWLKVPGGGALFARTLYEKYNVVVLPGGYLGRQGAHGNPADGYIRIALVATLEQNREAMHRIAQCAQEMIGQSQAV

SEQ ID NO: 4709 - protein, 458 aa, Oryza sativa
MASVAVPEWLNKGDNAWQMLSATLVALQGFPGLALFYAGAVTRKCALTSAFMALYAMAATMPCWALWAHNMAFGHRLLPFVGRPAPALAQHYMLTQALLPFTLHLHSNGEVETAAVAPLYPSASMVFFQWASAGVTVGLVAGAVLGRMSVKAWMAFVPLWTTLSYTVGAYSIWGGGFLFHWGVMDYSGGYVVHLAAGVSGYTAAYWVGPRRKEEEEMTMAGGGNLVAMVAGAGILWMGWTGFNGGDPFSANTDSSVAVLNTHICTTTSILAWVCCDIAVRGRPSVVGAVQGMITGLVCITPAAGLVQGWAALLMGVASGTLPCYTMNAAMSFKVDDTLGILHTHAVSGVLGGVLTGVFAHPTLCDMFLPVTGSRGLVYGVRAGGVQVLKQVAAALFVAAWNVAATSIILVVVRAFVPLRMTEDELLAGDIAVHGEQAYYFSSGTNCSLSHETIEVGNS

SEQ ID NO: 4710 - protein, 171 aa, Acidothermus cellulolyticus
FFIHDPLTGEAYSRDPRNVARKAEAYLVSTGIADTAYFGPEAEFYIFDEVRFETSAHQSYYHIDSVAGAWNTGRIEDNGNRGYKVRYKGGYFPVPPTDHFADLRAEMARELIRAGILVEKQHHEVGTAGQAEINYKFNTLLRAADDMQLFKYIVKNVAWRAGKTVTFMPKP

SEQ ID NO: 4711 - protein, 375 aa, Triticum aestivum
  unsure (1)..(375): unsure at all Xaa locations
MPAAQHIERDQDLAMSSDELLQAQLELYHHGLAFVKSLALKAATDLRIPDAIHRRGGAATLSELASDTGIHPTKRSNLRRVMRVLTTTGVFSIVQGKGSNDHAGDGAAYYKLTRVSRLLVERSPHNLSPMVGTIVNTLCWTSLLKMPEWFTQGQEGESAQSQSLVQLANGCTFWDTTKVDGGLFNDGMAADSRIAMKVLLKEHGGAFGEVKSSLVDIGGNHGATASAVARAFPHLKCTVLDLAHVVAAAPASDILTFVAGNMFEYVPPADAVLLKWILHDWKHEDCVKIMRRCKEAIPAKEAGGKVIIIDMVVGYPGDSAQXSKEAQVLLDIYMMGSDGMEREENEWSLIFXEAGFSDYKITPXNGIRSIIEVYP

SEQ ID NO: 4712 - protein, 297 aa, Vogesella indigofera
MGDKSVMPASRLWRDTLLTAVVPLIWGSTYLVTTQWLPAGLPFSAGVLRVLPAGLLLLLWTRHLPQRQEWPRLLLLSLLNIGAFQALLFVAAYRLPGGIAAVLGAIQPLLMMGLLWGLERQTPRPLVLLAACAGLAGMAVLLNAGNARWDSIGVLAAAGGAVVMALGMYLARRWGSSLPLLALTGWQLALGGLMLLPAALWLDPPLPALSAANVAGYAYLSLVGALLAYGLWFRGLRLLPPVAVSALGLLSPVAAVILGWVALGQRLHGWTLIGMVTVLASVLCVQLASSRRPARAG

SEQ ID NO: 4713 - protein, 370 aa, Triticum aestivum
MFMNCNFNSNLLEKEAGRTSFPWARPCDGCHAAPSAVYCCADAAYLCASCDTQVHSANRVASRHERVRVCETCESAPAVLACHADAAALCTACDAQVHSANPIAQRHQRVPVLPLPAVALPAASGFVEAEASVTAHGDKEEGEEVDSWLLRRNSDDNNCANKIDRYFNLVGYNMYYDNITCDPRPEEQYRMQEQQHVQNRYIEKEGCECVVPPQVVMASEQQESDYGTIGAGQAASVTAMTSTYTASISNDISFSSMEVGIVPDNTRPDISNSNILTSSEAMELSGHSLQMPVHFNSMDREARVLRYKEKKQTRKFQKTIRYATRKAYAEARPRIKGRFAKRSDIEHEEDHMLSPPALQDTSSYNTAPWF

SEQ ID NO: 4714 - protein, 334 aa, Bacillus anthracis str. A2012
MKKILLLATGGTIASVEGNEGLAPGLSAEELLNYFSRSSRNLEIDCKILMNIDSTNMQPEHWKEIANAVFNHYDDYDGFVITHGTDTLAYTSSALSYMLQGLRKPVVLTGSQVPISFKKTDAKKNVADALRFACEDVGGVFIVFDSRVIIGTRAVKMRTKSYDAFESVNYPYVAEVNEDEVKYHWKPTSSHNQLSINTNLCTDVFLMKLYPGTKPEIFDCLKDLYKGIIIESFGNGGLPFEGRNLLSKIQELTEMGVAVVITTQCLEEGEDILLYEVGRKVAQHQVILSGDMNTEAIIAKLMWALGKTNKLEEIKKIIEEPLSYDLTIKSDKDW

SEQ ID NO: 4715 - protein, 486 aa, Triticum aestivum
  unsure (1)..(486): unsure at all Xaa locations
MSGRVAAQQYAPVAPVDRGPALPPTLTPPRRGARKPEAEIARGEASPHPAPHRIGISPRHHSQPNPPAPRRRRRTTATAALGSPPAMASRMALRPHGVTPPLAAGRGGRRSGSVRVLAVASSASAKIESKKTFAPPKEVHVQVTHSMPPQKMEIFQSLDGWARDNLLLHLKPVEKCWQPQDFLPDPASDGFHDEVKELRERAKEIPDDYLVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGXSSTSDWRSGHETAYTKMVEKVFEIDPDGIVLALADVMMLDHFSMVAQXFGVYTARDYADILEFLLGRGEVPERTGASVVGHNAPRYNFPHAIGLCRRGARGPWRAEQAGRKDSRPVRGREVQDQKHATRASRSALGARRRPYLHVSR

SEQ ID NO: 4716 - protein, 212 aa, Tropheryma whipplei str. Twist
MFKVLVIDNHDSFIYTLVNYLQQLGVTTSVVRSDNNCHSVESMLGVHDAALISPGPGTPEESGITLSVIRAAYSTSTPLLGVCLGHQALAVAFGGDIGPSGRIMHGKLVTVRPRPSAIFKDLPTAFTATRYNSLTVTKVPQALRVIARADCGEVMALEHRTAPMYGVQFHPESAVSEWGFRILGNWLYISGFNKAPGISRDLPIVVYNTRVR

SEQ ID NO: 4717 - protein, 139 aa, Oryza sativa
  unsure (1)..(139): unsure at all Xaa locations
LLAPSVMDRGMGHFVVMSSAAGKVPSPGQALYSASKHALNGYFSSLRSELCTKGIKVTVVCPGPIEAPQSSGATSSSQKPSSESLYLSMIRLQKPVPVERCAELTIGCSNSRAKEAWVSYQPVLGVWXLVHYMPRWALA

SEQ ID NO: 4718 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 4719 - protein, 139 aa, Triticum aestivum
  unsure (1)..(139): unsure at all Xaa locations
MAPTVMASSVTSVAPFQGLKSTAGLPVSRRSNGASLGSVSNGGRIRCMQVWPIEGIKKFETLSYLPXLNTXXLLKQVDYLXRSXKWVPCLRXSTRVGFXFREQNASPGXTKGRYWXMWXKLPMFRMHPNPRKNQGGGKE

SEQ ID NO: 4720 - protein, 963 aa, Eremothecium gossypii
MRHRAKRIMNRSAALENEYFHYFSRFIYSYVDLSDNTALLMLKFYPDGVHNPYRTPYNYTAQIYSNFLNSTRTGSAQRDYGINFETFLSGVLISVIYCLCQTLLFSYLRTRLPRIYQPNVFLTEHPVAPVVLFRNFKTKLFSWVHPTWNTPLESYKKYGLDSFFFLRYLKVLCLYFLILSVMTIPVLIPIHYTSGYQVLDVPGNSREFGIRHRHTTEGDRLLTQFSLKSTGLDEISMSNISPRHSSRLIFHFILGIFAVVWFHATLITELDYFVTQRNSAFLGEDPAAQKQQCAMFLNNIPDMFMSSERGLLDFFHSMIPDSVHQIVFIPKEYRELKDKRKLEGKLFNEIEQVCYDIIRKRFYMSPKSESVYLPYKEESSTGSTILAPTAWASVENTLPEGVLPHSTFLNSYDEIFKPKNTTQSGFRFKLARWKYTLRTILTFDFIFGLRMKICTLKYNKLKILIPCIVYDVNRHIEKKLERLETTITQYNRLKQRGYKEITVYHSEQERPPTRNSSPPLKSKQAVVVFKNVILAHFFDQLLLSASTSSMKEKILGIKPEDIHWKNITLTNRLVLMSRVALSNFLSVMVIVGWVIPVAFVGLISQIPFLAKLVPLPSWSANSTSILDKSLSSIVPVMTLIFLTEGVPFLFRWFGWLKCCRSGSSTELDVQKWFFAFLFVHIFLVVTISSGISVIVEKLVNNPVSIPDLLGTNLPKSSNFFCSFMLIRGLSYFGGNFMQVKSLLFELFYYRWKVYTPRAVFERNVNVQQYQWGSVYPMFSVLACIGIIYCVISPIILLFASFSFALVMFSFKYSIKYQYNPVNNSESYGKYYPTALMQLYAGIYFLEICLIGLFTLSNCYRLSIGMIIVLIFTISAHFQIWSNYKYHLDHMPAQLCMEAIQNTPYNFRIPSLEGHERQVWLPNDTVGVSSSLKILLEEKYELPCQQNDCHLDENGKLVLTGYSS

SEQ ID NO: 4721 - protein, 255 aa, Haemophilus somnus 129PT
MARRPLVMGNWKLNGSKAFTKELITGLKDELNAVSGCDVAIAPPVMYLAEAETALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSVNDANAAELFTQPDIDGALVGGASLKASAFAVIVKAAAKAKN

SEQ ID NO: 4722 - protein, 582 aa, Mycobacterium tuberculosis H37Rv
MTTRSASPCTVLTDGCHLVVDALKANDVDTIYGVVGIPITDLARAAQASGIRYIGFRHEASAGNAAAAAGFLTARPGVCLTTSGPGFLNGLPALANATTNCFPMIQISGSSSRPMVDLQRGDYQDLDQLNAARPFVKAAYRIGQVQDIGRGVARAIRTATSGRPGGVYLDIPGDVLGQAVEASAASGAIWRPVDPAPRLLPAPEAIDRALDVLAQAQRPLLVLSKGAAYAQADNVIREFVEHTGIPFLPMSMAKGLLPDSHPQSAAAARSLAMARADVVLLVGARLNWLLGNGESPQWSADAKFIQVDIEASEFDSNRPIVAPLTGDIGSVMSALLEAAADRSSVASAAWTGELADRKARNSAKMRRRLADDHHPMRFYNALGAIRSVLQRNPDVYVVNEGANALDLARNIIDMHLPRHRLDSGTWGVMGIGMGYAIAAAVETGRPVVAIEGDSAFGFSGMEFETICRYRLPVTVVILNNGGVYRGDEATIFRSAAPVWRHDPAPTVLNAHARHELIAEAFGGKGYHVSTPTELESALTDALASNGPSLIDCELDPADGVESGHLAKLNTTSAATPAISGDG

SEQ ID NO: 4723 - protein, 449 aa, Gelidium pulchellum
VIPYAKMGYWDPDYAVKETDVLALFRVTPQPGVDPVEASAAVAGESSTATWTVVWTDLLTACDLYRAKAYKVEEVPNSSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLESHLDQNLPQGIFFEQDWAALRKVTPVASGGIHCGQMHQLLDYLGVDVVLQFGGGTIGHPDGIQAGATANRVALEAMVIARNEGRSFVEEGPQILRDAAKTCGPLQTALDLWKDI

SEQ ID NO: 4724 - protein, 229 aa, Yersinia pestis KIM
MEKRMKKYLIAPSILSADFARLGEDTAKVLAAGADIVHFDVMDNHYVPNLTIGPMVCKALRDYGITAPIDVHLMVKPVDRIVPDFAKAGATYITFHPEASEHVDRTLQLIKESGCKAGLVFNPATPLSYLDYVMDKLDVILLMSVNPGFGGQSFIPETLNKLRQVRKLIDDSGYDIRLEVDGGVKVENIRQIAAAGADMFVAGSAIFNQPDYAAVIDAMRNELAMAANG

SEQ ID NO: 4725 - protein, 358 aa, Clostridium tetani E88
MSMIDGIPSGKINGGGFYMKKILLLSTGGTIACSKGNEGLAPSLTAESLLTYTKEIQDICYIDTMQILNIDSTNMHPEYWVHITEYIETNYNNYDGFVITHGTDTMAYTAAALFYMIQDSHKPIVITGAQRPITFKETDAKRNLVDSIKFACNGIGGVFIVFDGKVICGSRAEKLRTKSYNAFESINFPHLATIEGNRIKYNDKISICKKKKELVFYKTLCTNIFLLKLTPATDPDILNYLSDKYLGIIIESYGSGGIPFKDKKDFLSKLKMLDQKGKIVVIKSQVLLEGTDLSQYEVGQKALKYPIIPAYDMSTEAIVTKLMWVLGQTKDKEKAREMFLTPVKNDLIIENIQQEMAK

SEQ ID NO: 4726 - protein, 229 aa, Zea mays
MAAGAALYYYHPGAGKVSLEAVAPSSPSLALRPSQSKVLCVSSSRWWMRRRWEGKASSVSSRARASARPALFSPVAMDWQECTTELEVDVPCSVAYQCYSERESIPQWMPFISSVKILEDKPDLSRWTLKYEVLGRDVEFSWLARNMTPIKNQKIHWRSLEGLANRGAVRFFPKSSSSCRVQLTVAYEVPEILAPVASALKPFLESLLLKGLERFATFAKERNSKIPQA

SEQ ID NO: 4727 - protein, 194 aa, Oryza sativa (japonica cultivar-group)
MAFASSLLPAPPASVAPELASFLPPQAKRGAVSLAATRRRGARIGVRAEVNESGSALAADAFAQVKHVLLPVTDRNPYLSEGTRQAAATSASLAKKYGANITVVVIDDKPKEEFPEHDTQMSSIRWHLSEGGFTEFGLMERLGEGKKPTAIIGEVADELELDLVVLSMEAIHSKHVDGNLLAEFIPCPVLLLPL

SEQ ID NO: 4728 - protein, 811 aa, Oryza sativa
  unsure (1)..(811): unsure at all Xaa locations
VNGKVLDKTAKVTLVGGDEVIFSSLGRHAYIFQQLPEERSSTSTFSATCAFQQGQYPVTKGTLDVSSKGAKLSVMPFNFGNGRPPLVPHDTEIVSSLCKTMEEQSQLASEENLQVAQHQLLKEDLKKVVVNASDISDSFDSFPYYLSENTKNALLSSAYVNLCCKESIKWTKHISSLCQRVLLSGPAGSEIYQESLVKALTKHFGAKLLIIDPSLLASSSKSKESESYKKGKTMHVLLVICTDSLSSDCFGRYDYGSQGEVRLPFEENESSKVGVRFDKKIPGGIDLGGNCEVDRGFFCPVDSLCLDGPGWEDRAKHPFDVIYEFASEESQHGPLILFLKDVEKMCGNSYSYHGLKNKIESFPAGVFIVGSQIHTDSRKDKSNSGSPFLSKFPYSQAILDLTFQDELELSQWKQLLDRDVEILKAKANTSKIQSVXVSMFLFCSVLFSGVDKVVGYALSHQFKHSTIPTRENDGLLALSGERDVTTENEFEKRLLGDVIPPDEIGVTFEDIGALENVKETLKELVMLPLQRPELFSKGQLMKPCKGILLFGPPGTGKTMLAKAVATEAGANFINISMSSIASKWFGEGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKNLCVTAAHCPIREILEREKKERASAEAENKPLPPPRSSSDVRSLRMNDFKHAHEQVCASITSDSRNMTELIQWNDLYGEGGSRKKTSLSYFM

SEQ ID NO: 4729 - protein, 241 aa, Oryza sativa
MPVSRGGKAASSKADPFDSDSDSDARYKDDFRDSGGLEQQSVQELENYAAYKAEETTDALGGCLRIAENIREDAANTLVTLNKQGQQISRTHEKAVEIDQDLSKGESLLGSLGGFFSKPWKPKKTRQIKGPAHVSDDSFKKKASHIEQREKLGLSPSGKSANRSYAEPTTAMEKVQVEKQKQDDALDDLSGVLGQLKGMACDMGSELDRQNKALDDLQGDVDELNSRVKGANQRARKLIEK

SEQ ID NO: 4730 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 4731 - protein, 288 aa, Staphylococcus aureus subsp. aureus MW2
MKKIKKAIIPAAGLGTRFLPATKAMPKEMLPILDKPTIQYIVEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKELGL

SEQ ID NO: 4732 - protein, 281 aa, Bacillus anthracis str. A2012
MPLVQMKDILMKANQENYGVGAFSVTNMEMVMGAIKAAEELSSPLILQIAEVRLNHSPIHMIGPLMVAAAKQATVPVAVHFDHGMTFEKIQETLEIGFSSVMFDGSHYPLEENIQKTKEIVELAKQYGATVEAEIGRVGGSEDGSEDIEMLLTSTTEAKRFAEETDVDALAVAIGNAHGMYNGDPNLRLDRLQEINDVVHIPLVLHGGSGISPEDFKQCIQHGVRKINVATATFQNVITAVNNTVLNTPYSDYFTYHQDVIKAAYENVKSHMQIFGSENRA

SEQ ID NO: 4733 - protein, 352 aa, Burkholderia fungorum
MLQRDPRPPGLVCPAGRRQSHFSRTTAHARPEGPNMTTALDQLKQYTTVVADTGDFQQLAQYKPQDATTNPSLILKAVQKDDYKPLLEKTVKAHASKPVGAIIDQLLIAFGTEILKIIPGRVSTEVDARLSFDTEGSIAKGRELIALYKEHGIGRERVLIKLASTWEGIRAAEVLQKEGIHCNMTLLFSLAQAAACAEAGAQLISPFVGRIYDWYKKNAGSAWDEAKDGGANDPGVKSVRRIYAYYKKFGYKTEVMGASFRTPGQILELAGCDLLTISPDLLQKLHESTEKVERKLSPDIAKESDIERVPVDESSFRFLVNDEAMATEKLAEGIRAFAADAIKLEKLIDALR

SEQ ID NO: 4734 - protein, 484 aa, Agrobacterium tumefaciens
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 4735 - protein, 429 aa, Polyopes polyideoides
  unsure (1)..(429): unsure at all Xaa locations
WEPEYVVKETDVLALFRVTPQPGVDPVEASAAVAGESSTATWTVVWTDLLTACDLYRAXAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVTEGPQLLQDAAKTCGP

SEQ ID NO: 4736 - protein, 581 aa, Pseudomonas aeruginosa PAO1
MSDSCLPIAMVQSAQSHRPGTKPEIPALMQTVYTVLTLLLVVGATRLAAQLLPLPLPLIQIAAGALLALPSLGLHIALDPELFLFLFIPPLLFVDGWRIPKREVWRMRWPILMMAFGLVFFTVVGAGYFIHLLIPEIPLAASFALAAVLSPTDALAVSAITQGRLPKRLMHLLEGEALMNDASGLVAFKFAIAAAMTGVFSLVDASLNFLVVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 4737 - protein, 245 aa, Bradyrhizobium japonicum USDA 110
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAAAVAAAGADTLVAGSAVFRGKSSADYAGNIAAIRVAAEAGRVSKLQDISVQPMRAGESARLR

SEQ ID NO: 4738 - protein, 495 aa, Pseudomonas aeruginosa UCBPP-PA14
MSIAIDPSVSAFLRSPHGLLIEGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 4739 - protein, 416 aa, Staphylococcus aureus subsp. aureus Mu50
MNLNDTIFMFLCTLLVWLMTPGLSLFYGGLVQSKNALNTVMQSMAAIVLVTFVWITVGFTISFGNGNLWFGNWEYTFLNHVGFATQEDISPHIPFALFMLFQMMFCTIAISILSGSIAEKMKFIPYLLFVVIWTALVYSPVAHWVWGGGWINKLGVLDFAGGTVVHITSGVSGLVLAIMIGKGNKHSESTPHNLIITLIGGIFVWIGWYGFNVGSAFTFDNIAMLAFTNTVISASAGAIGWLILEYIFKKTTSLLGLLLGALAGLVVITPAAGYVTYLSATIMALIGGICCYIVINYIKVKLKYHDALDAFGIHGVGGIIGAVLTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 4740 - protein, 573 aa, Nostoc punctiforme
MIRLQTNGTQKDMEQGYSDKAYRWNREKYSSRRRFVDIWSFVLTLLFKLWLYNKSWSYPGGVTEVKQTARRKTQAVWIRNTLLDLGPTFIKVGQLFSTRADIFPGEYVEELAKLQDKVPAFSYEQVEATIEKELGKKIPELFDNFEPIPLAAASLGQVHKAVLHSGESVVVKVQRPGLKKLFEIDLQILKGITRYFQNHPKWGRGRDWLGIYEECCRILWEEIDYLNEGRNADTFRRNFRGYDWVNVPRVYWRYASSRVLTLEYLPGIKISQYEALEAAGLDRKAIARQGAQAYLLQLLNSGFFHADPHPGNIAISASGALIFYDFGMMGRIKSNVREGLMQTLFGIAQKDGDRVVQSLIDLGAIAPTDDMGPVRRSVQYMLDHFMDKPFENQSVAAISDDLYEIAYNQPFRFPATFTFVMRAFSTLEGVGKGLDPEFNFMEVAKPYAMQLMTDMNGSEGNTFINELSRQAAQVSSTAFGLPRRLEDTLEKLERGDMRLRVRSIETERLLRRQSSIQLSMSYALLITGFTLSATILVVSNYVLWALVPGLIALGISVILIRLLLRLDRYDRMY

SEQ ID NO: 4741 - protein, 329 aa, Zea mays
  unsure (1)..(329): unsure at all Xaa locations
MKVIEKILEAAGDGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAXYPGEGGATLEAYSNDLAYLKRKVDAGADLIVTQLFYDTDIFXLKFVNDCRQIGITCPIVPGIMPINNYKGFLRXMTGFCKTKIPXSRSLAALDPIKDNEEAVRQYGIHLGTEMCKKILATGIKTLHLYTLNMDKSAIGILMNLGLIEESKVSRPLPWRPATNVFRVKEDVRPNVLLR

SEQ ID NO: 4742 - protein, 94 aa, Zea mays
  unsure (1)..(94): unsure at all Xaa locations
GGVKKPAEGGAPLPLKVKGQDANXVFFCIKRSPPLKKFINPFWAPQFVDINPLAFLFYGPRFSGEQTPFXLEMEDGHKINPIFPQTGGRVPSPP

SEQ ID NO: 4743 - protein, 257 aa, Oenococcus oeni MCW
MVHQLELPSSYLNYNGIMRKPIIIANWKMNFLRDQANLYVKKLIKKLGNKENIEVGIASQDLFLTDLIKLTENTPISIVAQNAYWENFGPFTGETSPKALANVGVDYVMLGHFERRELFNETNSTVNLKVRTALNNGMDVIVDVEELEQVAPVLEGVSEEQMQQIIIGFEPTFAIGTGMSASTKGAEDVAEQIRKTVRKLYGSDVADSTRILYGGSVNRDNLKSLIKQKDIDGVLVGKAALDFQSFWELVEIIENSL

SEQ ID NO: 4744 - protein, 363 aa, Salmonella typhimurium LT2
MSKNYHIAVLPGDGIGPEVMAQALKVMDAVRSRFDMRITTSHYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDANDAATAIEQAINRALEEGVRTGDLARGAAAVSTDEMGDIIARYVAEGV

SEQ ID NO: 4745 - protein, 501 aa, ASPERGILLUS NIDULANS FGSC A4
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTDQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 4746 - protein, 335 aa, Dechloromonas sp. RCB
MAINGFGRIGRMAFRAIAKEAEFADIAVVAINDLLEPDYLAYMLKYDSVHGNFAGDVAVDRNDLLVNGRRIRLSAERHPEQLAWGEVKADVVIEATGHFLTHDGCLKHVHAGARKVVQSAPAKDSTPMFVYGVNHETYAGEDIVSAASCTTNGLAPVAKVLHDKFGIRRGLMSTVHAATATQKTVDGPSGKDWRGGRGILENIIPSSTGAAQAVGKVIPALNKKLTGMAFRVPTSDVSVVDLTVELEKPASYADICAAMKAAAESGPLKGVLGYTGDSVVSTDFRGCRLPSIFDAGAGIALDPTFVKVVAWYDNEYGYTCNLLRLVRHISEAPTK

SEQ ID NO: 4747 - protein, 303 aa, Ipomoea batatas
RMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 4748 - protein, 146 aa, GIBBERELLA ZEAE PH-1
MSYPDQRSNDEWRAVLNKEEQFRILREKGTEAPGSGTFDKHYPDEGVYTCAGCEAPLYKATHKFKSGCGWPAYFDSIPGAVVRHEDRTFGMARTEIVCSNCGGHLGHVFKGEGYDTPTDERHCVNSVSLNFSPNDKIVKDKPESKA

SEQ ID NO: 4749 - protein, 266 aa, Triticum aestivum
MRRVRVSSHHSPVQKLGDSHMKLTPKFRLTAATTSPSSSELEQQPPWETPLIPGLPDDAALNCLLRLPVEAHGACRLVCRRWRHLLADKARFFTHRKAMGLRSPWLFTLAFHRCTGKIQWKVLDLDSLAWHAIPGMPCRDRACPRGFGCIAVPGEDGAHLLVCGGLVSDMDCPLHLVLRYDVCKNRWAVVPRMLSARSFFAGGVIDGRVYVAGGYSTDQFELNSAEVLDPVNGVWQPIASMGANMASSDSAVIGGRLYVTESCAWP

SEQ ID NO: 4750 - protein, 354 aa, Aquifex aeolicus VF5
MIPQRIKELEAYKTEVTPASVRLSSNEFPYDFPEEIKQRALEELKKVPLNKYPDPEAKELKAVLADFFGVKEENLVLGNGSDELIYYLSIAIGELYIPVYIPVPTFPMYEISAKVLGRPLVKVQLDENFDIDLERSIELIEKEKPVLGYFAYPNNPTGNLFSRGKIEEIRNRGVFCVIDEAYYHYSGETFLEDALKREDTVVLRTLSKIGMASLRVGILIGKGEIVSEINKVRLPFNVTYPSQVMAKVLLTEGREFLMEKIQEVVKERERMYDEMKKIEGVEVFPSKANFLLFRTPYPAHEVYQELLKRDVLVRNVSYMEGLQKCLRVSVGKPEENNKFLEALEESIKSLSSSL

SEQ ID NO: 4751 - protein, 165 aa, Zea mays
  unsure (1)..(165): unsure at all Xaa locations
MDGRMFGLETPLMVALQHLLDVPDGDAGAGGDKASGAAAGGGPTRTYVRDARAMAATPADVKELPGAYAFVVDMPGLGTGDIKVQVEDERVLVISGERRRXEREDAKYLRMERRMGKFMRKFVLPDNADMDKISAVCRDGVLTVTVEKLPPPEPKKPKTIEVKVA

SEQ ID NO: 4752 - protein, 632 aa, Trichodesmium erythraeum IMS101
MIEKNKVKQSILASQKHLLSLQETEGYWWGQLESNVTITAEIILLHKIWQTDKKIPLNKAKNYLISQQREHGGWELFYGDGGDLSTSIEAYMALRLLGVSRTDPIMIEAQNFIIKKGGISCSRIFTKLHLALIGCYSWQGIPSIPSSIMLLPEDFPFTIYEMSSWARSSTVPLLIVFDKKPIFSVNPTINLDELYAEGINNASFELPRKYDLTDLFLGLDKAFKFAENLNLMPLQQEGLKAAEKWILERQEVTGDWGGIIPAMLNSMLALKCLEYDVADPVVVRGLEAIDRFAIENEDSYRVQACVSPVWDTAWVIRSLVDSGISPSHPAMVKAGQWLLQQQILDYGDWVFKNKFGKPGGWAFEFMNRFYPDIDDTAVVVMALDVVELPDEDLKGKAIARGMEWIASMQCEAGGWAAFDVDNNQDWLNATPYGDLKAMIDPNTADVTGRVLEMVGCCGLAMDSWRVKRGIDFLVREQEEEGCWFGRWGVNYIYGTSGVILALAVMARESHRGYIERGASWLVGCQNSDGGWGESCWSYNDPSLKGKGKSTASQTAWALIGLLAAGEGTGNFARDAIDGGVGFLVSTQNDDGSWLEDEFTGTGFPGHFYIKYHFYSQYFPLMALGRYESLLSG

SEQ ID NO: 4753 - protein, 373 aa, Candida maltosa
MSVKTKTITILPGDHVGTEIVNEAIKVLEAIEAATPYQKIHFDFKHHLIGGAAIDATGVPLPDDALESAKNSDAVLLGAVGGPKWGTGALRPEQGLLKIRKELNLYANIRPCNFASDSLLELSPLRPEVVKGTNLIIVRELVGGIYFGDREEQEESADKQTAWDTEKYTVDEVTRITRMAAFMALQHTPPLPIWSLDKANVLASSRLWRRTVDKVISEEFPTLSVQHQLIDSAAMILIQNPTKLNGIIITSNMFGDIISDEASVIQGSLGLLPSASLASLPDTNTAFGLYEPCHGSAPDLPANKVNPIATILSAASMLRLSLDCVKEAEALEEAVKQVLDKGIRTADLRGTSSTTEVGDAIVEAVTKILKEKA

SEQ ID NO: 4754 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 4755 - protein, 474 aa, Pinguiochrysis pyriformis
RYESGVIPYAKMGYWDADYTVKDTDVLAMFRITPQPGVDPIEAAAAVAGESSTATWTVVWTDLLTACDVYRAKAFRVEPVPGASDHFFSYIAYECDLFEEGSLPNLTASIIGNVFGFKAVKALRLEDMRIPYAYLKTFQGPATGLIVERERMDKYGRPFLGATVKPKLGLSGKNYGRVVYEGLRGGLDFLKDDENINSQPFMRWRERFLYVMEGVNRAAAASGEVKGSYLNATASNMEEMYTRAEYAKSVGSIIIMIDLVIGYTAIQSMAAWSRENDMILHLHRAGNSTYARQKNHGINFRVICKWMRMSGVDHIHAGTVVGKLEGDPLMVKGFYNTLLDNELTINLPQGLFFDMEWASLRKCVPVASGGIHCGQMHQLIHYLGEDCVLQFGGGTIGHPDGIQAGATANRAALEAMVLARNEGRDYLAQGPEILNSIAKKCRPLQVALDLWKDISFNYTSTDTADFVETPTQNV

SEQ ID NO: 4756 - protein, 615 aa, Oryza sativa
MPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGNIMAYHGQLDGRQASGLMRDGAFPAASLSGRQPLDRAATALEILEKKLAEQTAEAEKLIRENQRLASSHVVLRQDIVDTEKEMQMIRAHLGDVQTETDMHMRDLMERMRLMEADIQAGDAVKKELHQVHMEAKRLIAERQMLTVEMDKVTKELHKFSGDSKKLPELLTELDGLRKEHQSLRSAFEYEKNTNIKQVEQMRTMEMNLMTMTKEADKLRADVANAEKRAQGYTQAALPGYPSAYAAPQQPISSGVATDVASMYGAISSAGYPAGVVQSSSGAANAGQAPATYPVAYDPTRAGQR

SEQ ID NO: 4757 - protein, 702 aa, GIBBERELLA ZEAE PH-1
MSTPTTATATLPHYHHPHHYPQSYAHSHSHHQPYQPNPSASYRSTASNQNILPPPVSSAVSPSHSAILPPPYQLSPLAYSSTASNGIGLTHSSTSRSAHHAQEPSPRHDAGYSTATMPETAPASHAEPSRKRRRSREPDWNTFYKNGLPKEIIVIDDTPEPEANTSRKITNSTVVAPNDTTNRLAAKKRRQNEETGTVQASGYHIKYLESKNNTPVQITTPAGSSNSSSDRTNSGVNTTAPTSLSSNGQYEDAAAPLKRKRTRQQVANEAKRRDVDGLGDIFTYKPPPYPPKKAGEVNVQVIHDRHYNKNVKVDDDDGHYIVIPEAELTDKYQIVRLLGQGTFGKVVEARDRKHNKAVAVKIIRSVQKYRDASRIELRVLETLKRNDEENRNRCIHLRDCFDYRGHICIVMDLLDQSVFDFLKGNGFVPFPNSQIQSFARQLFTSVAFLHDLNLIHTDLKPENILLCDHAYQTFTYNRKIPSSSTTINRQATQRRVLLDTEIRLIDFGSATFQDEYHSSVVSTRHYRAPEIILGLGWSFPCDIWSIGCILVEFFTGDALFQTHDNLEHLAMMEAVVGSRIDSHLVQAVNKMSNRNGGNAASKYFKRLKLDYPTPETTRGSRRFVKAMKHLDHIIPGNNPFLKNFVDLLQKIFVYDPAHRITAKQALQHPWLKETAQPDDGTEAAKIRQERIRSEQRNQYVRS

SEQ ID NO: 4758 - protein, 374 aa, Kluyveromyces wickerhamii
MFRLARAQSSIANKSVARHFLRLNSTYAIPETQKGVIFYENGGELHYKDLPVPVPKPNEILINVKYSGVCHTDLHAWKGDWPLAVKLPLVGGHEGAGIVVAKGENVTNFEIGDLAGIKWLNGSCMSCELCEQGYESNCLKADLSGYTHDGSFQQYATADAVQAAQIPKGTDLAEIAPILCAGVTVYKALKTADLKPGQWVAISGAAGGLGSLAVQYAKAMGLRVLGIDGGDGKEELFKKCGGEVFIDFRKSKNMVADIQEATNGGPHGVINVSVSEAAISMSTEYVRPTGTVVLVGLPANAYVKSEVFSHVVKSISIKGSYVGNRADTREAIDFFTRGLVKSPIKVIGLSELPEAYELMEQGKILGRFVVDTYK

SEQ ID NO: 4759 - protein, 632 aa, Glycine max
RRNLRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKEQAAAVSEGRPAPALSGSGDIRSLNMEDFKYAHQQVCASVSSESINMTELQQWNELYGEGGSRVKKALSYFM

SEQ ID NO: 4760 - protein, 237 aa, Paenibacillus macerans
MKKKSCFTLVTTFAFSLIFSVSALAGSVFWEPLSYFNPSTWEKADGYSNGGVFNCTWRANNVNFTNDGKLKLGLTSSAYNKFDCAEYRSTNIYGYGLYEVSMKPAKNTGIVGSFFTYTGPAHGTQWDEIDIEFLGKDTTKVQFNYYTNGVGGHEKVISLGFDASKGFHTYAFDWQPGYIKWYVDGVLKHTATANIPSTPGKIMMNLWNGTGVDDWLGSYNGANPLYAEYDWVKYTSN

SEQ ID NO: 4761 - protein, 398 aa, Shewanella oneidensis MR-1
MAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 4762 - protein, 473 aa, Antirrhinum majus
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKAPTLTSTLTARSKAASGVKTKTKEQIVDIDAADVNNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASVYAARCTLNKAPFWNETLQLHTGFSEPQLMDCAKLLVAFPKMAGDQKLKSIYRKYSNLERGAVALLSPAKSVFVFLIELLMNAIEKIQCSLFFTSEIWCRF

SEQ ID NO: 4763 - protein, 366 aa, Arabidopsis arenosa
MEKGEDSSTFKMGNSAPGPAQKIIGPCAMSLPYVPDCYVVPPSCEPCDSNSEIVPTIDVSRLKGGDDERRGVIRELSLACQHLGFFQIVNHGINQNILDDALEVARRFFELPAKEKKKFMSNDVYAPVRYSTSLKDGLDKIQFWRIFLKHYAHPLHRWIHLWPENPPGYREKMGKFCEEVKELSIEIMGAITESLGLGRDYLSSRMDENGMQVMTVNCYPPCPDPETALGLPPHSDYSCITILLQNLAGLKIFDPMAHGGSGRWVAVPEVTGVLKVHIGDHVEVLSNGLYKSIVHKVTLNEENTRISLASLHSLGMDDKMSVPCELVTDENPVRYKESSFKDFLDFLVKNDISQGDRFIDTLRIKD

SEQ ID NO: 4764 - protein, 142 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4765 - protein, 402 aa, Bacteroides thetaiotaomicron VPI-5482
MEKNIFKLDNEQLKAIVCSFRDKTEEGLKTENAEIQCIPTFIAPKTTHIKGKSLVLDLGGTNYRVAIVDFDKATPTVHPNNGWKKDMSIMKSVGYTREELFKELADMIIGIKREEEMPIGYCFSYPAESVPGGDAKLLRWTKGVDIKEMVGEFIGKPLLDYLNERNKIKFTGIKVVNDTIASLFAGLTDNSYDAYIGLIVGTGTNMATFIPADKIEKLDQSCNAHGLIPVNLESGNFHPPFLTAVDDTVDAISGNPGKQRFEKAVSGMYLGDILKTAFPLEEFEEKFDAQKLTSIMNYPDIYKDVYVQVAQWIYGRSAQLVAASLTGLIMLLKSYNKDIRKVCLVAEGSLFWSENRKDKNYNILVMEKLRELLQLFGLEDIEVDIKSMNNANLIGTGIAALS

SEQ ID NO: 4766 - protein, 340 aa, Selaginella lepidophylla
MGSEAKIKIGINGFGRIGRLVARVVLERDDVELVAVNDPFISTEYMAYMFKYDSVHGKWKKADVEVKDHETLIFGGKPVGCFACKDPSEIPWGKFGAEFVVESTGVFTDRDKASAHLKAGAKKVVISAPSSNAPMFVMGVNENDYKPDIDIVSNASCTTNCLAPLSKVINDRFAIIEGLMTTVHSLTATQKTVDGPSSKDWRGGRGAGFNIIPSSTGAAKAVGKVLPALNGKLTGMAFRVPTADVSVVDLTVRLEKPASYEEIKKAVKEESEGKLKGIMGYTEDAVVSSDFIGDSRSSIFDAAAGIALNDSFVKLVSWYDNEWGYSNRVVDLIVHMAKTK

SEQ ID NO: 4767 - protein, 577 aa, Saccharomyces kluyveri
MFTRGVNGANRDIDALADNIGQLSFDASDPNKFIFEPTTPSKYKENGSTTGTPSPTKSTLYDDNAGDVSKLSMMDIDERTQDEIDVTKSPKKLPLNFYAKASSSKTKRLVNVCQMYFLDYYCDMFDYVISRRERTRQVMKYLEQQRGQGIQPQQISNEWQGYLNKETNTLRKRRLKPKNKDFEMITQVGQGGYGQVYLARKKDTKEICALKILNKKLLVKLNETNHVLTERDILTTTRSDWLVKLLYAFQDPQSLYLAMEFVPGGDYRTLLINTRFLQAPHARFYISEMFCAVDALHQLGYTHRDLKPENFLIDSKGHIKLTDFGLAAGTVSMERIESMKLRLEEVKNLEFPEFKERSMDDRRRMYKKLRESDVNYASSTVGSPDYMALEVLEAKSYDFTVDYWSLGCIMFESLVGYTPFSGSSTNETYENLRRWKQVLRRPRCENGRYAFSDRTWDLITRLIADPVNRVRSFEHVKRMKYFAEIHFDSLRSMSPPFIPQLDSETDAGYFDDFSNEADMAKYADVFKRQDRLTAMMDDSSADSKLVGFTYRHRKGKNGSSGVLYGGAEHADPFATFY

SEQ ID NO: 4768 - protein, 220 aa, Clostridium perfringens str. 13
MSTNKSSIEKITLGSFLIALGVVYGDIGTSPLYVMKSIINGNGGLESITPDFILGVLSLIFWTMTLLTTIKYVLITLKADNKGEGGIFSLYTLVRRRAKWLIIPAMVGGSALLADGMLTPAVTVTSSIEGLKILPNFNDIFGNNQDIIIIIVLVILSFLFFIQHFGTEIIGKIFGPVMFIWFAFLAILGIVNLSGNLYLLKALSPHYAIKILFSPNNHLG

SEQ ID NO: 4769 - protein, 121 aa, Eremothecium gossypii
MDPELQALREARLAELKNKQGGEARAGEGVQQYMAPEALERLARVALVRPKRARAAEAYVQQLAARGVLRARISEQQIVEILDGMARDEQRRTETKIIFDRRGEPDRTAGTSADSDDDFFD

SEQ ID NO: 4770 - protein, 228 aa, Zea mays
MPLWGAAASAAPAADGDAARAPSGSGGGVKVIRSLLPTRRRLRLDPPAKLYFPYEPGKQVRSAVRIKNISKSHVAFKFQTTAPKSCFMRPPGGVLAPGESIIATVFKFVEHPENNEKPMDKCKVKFKIVSLKVKGPVEYVPELFDEQKDQVAVEQILRVVFLDAERPSPQMDKLKRQLAEAEAALEARKKPPEDNGPRIVGEGLVIDEWKERRERYLARQQIEGVDSV

SEQ ID NO: 4771 - protein, 512 aa, Catharanthus roseus
MALEKLVLFDFLAAISILILVQKFIQIVFLRSSSRIRLPPGPKGWPIIGALPYLGTMPHSILANMAKKYGPIMYLKLGTNGMVVASTPDAVKAFLRTLDMNFSNRPIDAGATHLAYNAQDMVFAHYGPKWKLLRKLSNLHMLGGKALENWSNVRATELGYMLQAMYESSRKGETVVVPEMLTYAMANMIGQVILSRRVFVTKSLESNEFKDMVVELMTTAGYFNIGDFIPSIAWMDLQGIERGMKRLHKKFDALLTKMLEEHKSSSHKRKEKPDFLDYVLANRDNSEGERLTTTNIKALLLNLFTAGTDTSSSVIEWAISEMLKNPTILKRAQEEMDQVIGRNRRLMESDIPKLPYLQAICKETFRKHPSTPLNLPRIAQKDCQVNGYYIPKGTRLSVNIWAIGRDPNVWENPLEFNPDRFLSGKMAKIEPRGNDFELIPFGAGRRICAGTRMGIVLVEYILGTLVHSFDWKLPFDDINELNMDESFGLALQKAVPLVAMVSPRLPINAYSP

SEQ ID NO: 4772 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 4773 - protein, 564 aa, Oryza sativa
  unsure (1)..(564): unsure at all Xaa locations
MAGGARKGSAEPKNRPLSLSFGRCSNVRYDSVKNFGFAKENQVYSKHEVSNLKDSSEVTEEVLLTSLRRVLDQYSSLQAPDGYWPGGYSGILFILPLMNEDGGWSTHTLGPSSMFGSCVNYATLRLLGEVLDEHNDGLSKGRAWILSHGSATVAPQWAKIYLSVIGVYDWSGNNPIIPELWLLPHFLPIHPGRFWCFCRMVYMPMSYIYAKRFIGPITPTILALREELYDVPYNKINWNNARISCCKDDIIYPPSWFQNIAMASLHKFMEPLFNMWPMNKLRKRALTNLMDHIHYEDENSNYVGLCPINKVXNMICCWIENPNSNAFRRHVPRIHDFLWLADDGMKSKVYVGSRCWDTALIVQAYCSTGLTQEFSETIKKAHDFIKNAQVTKNCPNYKRYYRERSKGSWTLSNGENGWPIADTLAECLKAVLLLSKIPPTQVGDPIQEQRLYDAIDCLLSYVLADTAILYILSKNKDGTLSSAESKRTTPWVEDWVNPIPPTPNPAAYNPAFVSGSEGGITFTVPLEMETMWWCFTTDHVSSDVPRVTIITCQVIMPPAKKVHK

SEQ ID NO: 4774 - protein, 143 aa, Glycine max
MGNPEKLMAQIFDLKFTSKSLQRQARKCEKEEKEQKLKVKKAIEKGNVDGARIYAENAIRKRTEHMNYLRLASRLDAVVALLDTQAKMQAIGKSMGSIVKSLDSSLATGNLQKMSETMDSFERQFVNMEVQAEFMEGAMAGST

SEQ ID NO: 4775 - protein, 233 aa, Guillardia theta
MSSYNLSSFNSKGKISQIEYASKAVLQSNTVISVKGNNLLLTLTLDISNKKNIFTQIEPKVFIINKYIILSASGLKSDIIIVISKARSICRDFQHKYGHQISTASLSKDLSSFLQNFTSSSGFRPLGVSLNILGIDKDGPELFEINTSGEINDVNFSSIGKSSKDIKEYIRARWCSNLETKTLLKLVINCLNYYNLVTSKLVEIVIATINTQPKIKIFSKEDLSILNNTQISN

SEQ ID NO: 4776 - protein, 362 aa, Sorghum bicolor
MGSTAEDVAAVADEEACMYAMQLASSSILPMTLKNALELGLLEVLQKDAGKALAAEEVVARLPVAPTNPAAADMVDRILRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 4777 - protein, 654 aa, Rhodopseudomonas palustris
MDSGTFNPGGERGNTLDASIDAARAALLGYRRDDGHWVFELEADCTIPAEYVLLRHYLGEPIDAALEAKIAVYLRRTQGAHGGWPLVYDGEFDMSATVKGYFALKMIGDSIDAPHMAKAREAILSRGGAVHANVFTRFLLAMFGILTWRAVPVLPVEIMLLPMWSPFHLNKISYWARTTIVPLMVLAALKPRAVNRLGVGLDELFLQDPKSIGMPARGPHQNRGLFALFGAIDAVLRVIEPLIPKKLRKHAIDRAVAFVEERLNGEDGLGAIYPPMANTVMMYKVLGYPEDHPPRAITRRGIDLLLVIGEEEAYCQPCVSPIWDTSLTCHALLEAGGAEAAQPVREGLDWLLPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGAMLDPPTEDVTARCVSMLAQLGETEQTSKAVARGVAYLRKTQLPDGSWYGRWGMNYIYGTWAVLCALNAAGVDHQDPAIRKAVAWLASIQNADGGWGEDGVSYRLDYRGYETAPSTASQTAWALLSIMAAGEVDHPAVARGIEYLKGTQTEKGLWDEQRHTATGFPRVFYLRYHGYSKFFPLWGLARYRNLRATNSKVVGVGM

SEQ ID NO: 4778 - protein, 350 aa, Oryza sativa (japonica cultivar-group)
METPLSSRRITRSMAKASAAAPDATSTAHPPRPALHDITNDSPIVGLASSGLRTPASTAAKARPTRASRRTPGSGEALLRGQVKTLLQKVHHDASSSSSCAAAAPPSPNILRIHAPIGLARSPAHLLAPTPANTPHLTAAAPHAFTMTVPCVLEEELLSKLQVIADALPPPPAQAEENHLGECNRALVFDDSPGKSDLSNAASVLSSSSLSFQDSSSTDRSPDDDSSSAWSIQVNASSEKGDEDTFTDQDPEEEEEEWLTEDDDDDECFDDLCEGMSKMSVFDDEEEEDKKAGLPAFQGKHTRFIYDSDGEMEREDVAHVPVENCTMVLRGLPVPEGKHLRFHEVEEDEE

SEQ ID NO: 4779 - protein, 567 aa, Kluyveromyces lactis
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 4780 - protein, 424 aa, Chlamydophila caviae GPIC [sequence omitted]

SEQ ID NO: 4781 - protein, 164 aa, Zea mays
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 4782 - protein, 131 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4783 - protein, 182 aa, Zea mays
MGVQEVLSRKSGVIVGDDVLRLFEYAREHKFAIPAINVTSSSTVVAALEAARDAKAPVILQFSQGGAAYFAGKGVSNGDQAASIAGSVAAAHYVRSLAPTYGIPVVLHTDHCAKKLLPWLDGMLDADEAYFKEKGEPLFSSHMIDLSEEPVEWNIETTAKYLKRAAPMKQWLEMEIGITGGE

SEQ ID NO: 4784 - protein, 357 aa, Triticum aestivum
  unsure (1)..(357): unsure at all Xaa locations
MSGGVEPETPPSSGGSATGSPMARKPPRHQLTAIRHCASSARIAAASTDLGLDSGTLSLISPADIRPSFLPVFRSGSCANIGPKSYMEDEHVCIDSLIEHLGMPTPAIPAPGAFYGVFDGHGGTDAVCFVRKNLLKFIIEDGHFPNSMEKAIRSAFVXADHAIADSHSLDRNSGTTALTALILGRTWLVAMSGYCRTVLATRGGEGERSKDHVPSXFEGYLNGQLSVARAIGDWHVKXGSKGSISPLTPEPEFQEVRLTEEDEFLIIGCDGLWDVMTSQCAVSMVRKELMAHNDPERCSRELVQEALRRDTCDNLTAVVVCFSADPPPQIEIPRFRVRRSISMEGLHMLKGALDSNA

SEQ ID NO: 4785 - protein, 1786 aa, Neurospora crassa
MYQNGQRDPPRPFAVPPPPPPMSPPQVGSGVAGINSVMNIPPPPPRYPGAPGTVGGSLLPPPPGPPPGNPGFPPSAIAPPSALGAAPWHGAWGRPYNGQTAFNLPPPPPGGNGGLQAYNPLLHAQAAAAAAAAAASASNTPGPPATSITIPPPPPPSEQMSATYIPSAGDTYGEGVGIPGLGLPEELGGPGNWTGAEQQRLGGTSMEDAHRLHAAPTADRGLSTTSNTPNSSSAIPPELAAQWPLDRVLMWLQANSFSQDWVNTFKVLNLHGAQFLELGSGHGGRGNFGMMHQQVYPQLAHECQMSKTGWDQTKEREEGKRMRRMIRGIVTGRSVDPSKVAASGGAQGGAGGAGGGGHARRESVSASVPPSAGPDSADSPNVEFSKSHLFVQEEQVQSGPKAPGPGFAGRRFSQSRATTMPLLTSTMSSGEPNHRSMMRNLDIDSARRHSPSTSNVSESGDLNAGTFRTVGRERQDSPIGGSPNPSSALFPSNAGNTILSSSPHRSGSRFGHRSRNSSDSVSSNAAQYGSGIPADAAAMFKNGSLADMIKNSFNSNNPDRRNGQDGGRPLGVVETGDRSAGTDPPNSAKGPKSFLSFLSRNKRKEDGTSPDELDSPTSPATGFKAHSLGSRAGHVSETSLDQRPGSSISTHEHSVGFQSGHSRKKSVVSTRVYLLATLDHWNYRMLDVTDIDSAHDLRQLVCINLGLPDSEGAAIYVTELGKFDHEEPLDDMKLLTNKRLRADAIGTLKLFVKPGGLTSSPYPGPGTQSGQPSSYVPRDAPPMDEETFNRLNGQRQRSSSSPPTSRQNTISSKDRDEKMPVPEPVEHKAEPPRKHAIKETSPIGETTPFGIVGRKVDFDQPRLSPFEDKRPDHLFPVRKAPAPPGDPSATLKKVNSLSKKTGQGFRPSTAHATQHHHHNAIDHGYHQRRVSTDIRENMTSERQTRRPAAIRGTAEVPSPSGGIGSLLINIGGHLGGIGHPVAGGARALSPNRVASAPVGHGGEMSEQQRDAKLRYQAARAPSPSLSPNARRRPSESHISQQQYQQNHRPPSSQQHHPHLQHQAQPQPQPQPQQQQQQQQQQQQQQQYQPRQQQTQQPQQQQQAQQPQQQQQAPAQHEESKRKSHGPDVDFSDNDVRFTPPPESESLNASSNHQDYADDQDDSDDSDDGLFAVPISKNKTAETSKTKDNSGGSDEGLGKRPSLKVATDRSKKNLSVAFTTPQASPRMASFTDETEHASVPASSGHGHRQSAPVPSGSSKEWEQDETECKIGRRKSFIEKDVWANRPPTDALINNLEDFFPNLDVDQPVLEEGGDTEVEVDAPSPIAEVDESQFQTRPQPMAETMAQSNTAVASSSNNNAPMLPPLNRVSSAFNESDTLGSDESTLKALESRPPSMVSGSVRRSRGLGRMKSIREVARGAHEAHKRYTQTSMQTNVATPAVPNATTNLMRRKSTKMFNANIVQIEPRRGSILSTIPQETLPTQDNINTLPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKDEAVGAIYKIANGEAPPIPDDIREEITPIAIAFMLDCFTVDPTDRPTADVLLSQHPFCELDPNYSFMDTELYAKIRGTY

SEQ ID NO: 4786 - protein, 242 aa, Vitis vinifera
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQLSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 4787 - protein, 300 aa, Actinobacillus actinomycetemcomitans
MKGIILAGGSGTRLYPITRGVSKQLLPVYDKPMIYYPLSVLMLAGVRDILIITTPEDNESFKRLLGDGSEFGVNLQYAIQPSPDGLAQAFLIGEGFINGDSCCLVLGDNIFYGQNFTQMLQQAVARPYGATVFGYLVKDPGRFGVVEFDENFKAVSIEEKPVQPKSNYAVTGLYFYDNRVVDFAKQVKPSARGELEITTLNEIYLKDGSLNVQLLGRGFAWLDTGTHESLHEAASFVRTIESVQGLQVALLRRNRGRNGWLSEIAWRNGWLTSKQVEILARSMVKNEYGQYLLRLINEEK

SEQ ID NO: 4788 - protein, 219 aa, Triticum aestivum
  unsure (1)..(219): unsure at all Xaa locations
MLRVEEALAAVLSAAAACRAAPSAVPLLDALGLVLAEDVRAPDPLPPFRASVKDGYAVVAADGPGEYPVIAEARAGDDALGVVVAPGTVAYVTTGGPIPDGADAVVQVEDTEQVAAAPDGSKRVRISARVAEGHDIRSVGCDIEKDYIVLKSGENIGPAEIGLLATVGVTTVKAYRRPTIAVFSTGDELVQPATGTLNRGQISDFNRALLLAAAXXRKC

SEQ ID NO: 4789 - protein, 913 aa, GIBBERELLA ZEAE PH-1
MSCLPSCFIASKIREFLEEYESQSNREGSSQGTFNLGFTFSFTCEQTSISRGTLVHWDKGWDIPSAIDQDPCSLLQEAVDETGLPVRVCVLANDAVGTLLTKAYTAEKSSSALAAIILGTGTNAAYVEDITNIQRLNTDEKWTEKDHEGVMVINTEWGSWDDDLKVLPQTRFDKLIDESSSDPGCGLLEKMVSGMYLGELLRLIILELVLNGSLSITFEEDSPIHQFTGIETSFLTKITAFGLEDTAGSLDYLTKTLAVKDVTIEEMLKIQALSKAIIKRSARLVGTGLAAIIIQSGRLQPSTTQKTTTTAQTQEIAQKPVKQQKGGAISSLAKFIRSIFGCMRPEDDTSIPVVKSPYGSEEIIESTILVEEDINIAVDGSLFEYHAEFEELMRSALRDVAEIGSVNERRIKIELTKDGSVTSEGQDSYLPQGLFQVSLTLTLTNTSYHYSVSVDDVVTMVKAKSWAITKGLLFLSTLLSTSSVVNADNPIVQTVYTADPAPIVHNGRVYLFTSHDEDGSTNFNMKDWRLFSSNDMVNWQHHPSPMGLTTFSWANDRAWAGQVASRNGKFYYYVPVAMKNGRMAIGVGVSDNILGPYRDALGKPLVENNEIDPTVFIDDDGQAYLYWGNPGLWYVKLNQDMISYSGGVNKVQLTTAGFGSRPNSAERPTNYEEGPWLYKRNGMYYMIYAANCCSEDIRYSTGPTATGPWTYRGVLMAHEGKSFTNHPAVIDFENKSYFFYHNGALPGGSGYTRSVAVESFQYNSNGLIPQLRMSTTGPAQVRSLDPYTRQEAETIAWTNGVETEACSEGGLAVSFINNGDYIKVKGVAFGNGAQSFSARVASANSKGGKIELRLGSETGKLVGTCTVPSTGGWQTWKTVDCPVSGATGTSDLFLRFTGEGSDYLFNVNWWQFK

SEQ ID NO: 4790 - protein, 666 aa, Streptococcus agalactiae NEM316
MQHVNHSSFDKASKAGFIIALGIVYGDIGTSPLYTMQSLVENQGGISSVTESFILGSISLIIWTLTLITTIKYVLVALKADNHHEGGIFSLYTLVRKMTPWLIVPAVIGGATLLSDGALTPAVTVTSAVEGLKVVPSLQHIFQNQSNVIFATLFILLLLFAIQRFGTGVIGKLFGPIMFIWFAFLGISGLLNSFAHPEVFKAINPYYGLKLLFSPENHKGIFILGSIFLATTGAEALYSDLGHVGRGNIHVSWPFVKVAIILSYCGQGAWILANKNAGNELNPFFASIPSQFTMHVVILATLAAIIASQALISGSFTLVSEAMRLKIFPQFRSTYPGDNIGQTYIPVINWFLFAITTSIVLLFKTSAHMEAAYGLAITITMLMTTILLSFFLIQKGVKRGLVLLMMIFFGILEGIFFLASAVKFMHGGYVVVIIAVAIIFIMIIWYKGSKIVSRYVKLLDLKDYIGQLDKLRHDHRYPIYHTNVVYLTNRMEGDMIDKSIMYSILDKRPKKAQVYWFVNIKVTDEPYTAEYKVDMMGTDFIVKVELYLGFKMRQTVSRYLRTIVEELLESGRLPKQGKTYSVRPDSKVGDFRFIVLDERFSSSQNLKPGERFVMLMKSSVKHWTATPIRWFGLQFSEVTTEVVPLIFTANRGLPIKEKIELTTTGD

SEQ ID NO: 4791 - protein, 775 aa, Oryza sativa (japonica cultivar-group)
MDAETGPAAPQDQWKSYCRTISLLAFQSFGVVYGDLSTSPLYVYKSAFSGRLNNYRDETTIFGLFSLIFWTLTLLPLLKYVIIVLNADDNGEGTFALYSLLCRHAKFSLLPNQQSADEELSTYYQPGVGGIISSPLKRFLEKHRKLRTCLLLFVLFGACMVIGDGVFTPAISLSAISGLKDPGPGGIPDWVVFIACIVLVGLFALQHRGTHRVAFMFAPIVVVWLLSIGVIGLYNIIHWNHRIFLALSPHYVIKFFKMTGKDGWLSLGGVLLAITTEAMFADLGHFTAASIRLAFVGAIYPCLVLQYMGQAAFLSRNMSAVEDSFYQSVPSLFWPVFVIATLAAVVGSQSIISATFSIVKQCLSLGCFPRVKVVHTSRWIHGQIYIPEINWILMVLCLAVTLGFRDTTVIGNAYLACIVVMFVTTWLMALVIIFVWQKNILLALLFVVAFGSIEVVYLSAAVTKVPQGGWAPIVFAFVFMLVMYVWHYGSRRKYLFDLQNKVSMKWILTLGPSLGIVRVPGIGLIYTELVTGVPSIFSHFVTNLPAFHQVLVFVCVKSVPVPFVPEDERYLIGRIGPREYRMYRCIVRYGYKDVQKDDENFENHLVMSIAKFIQMEAEEAASSGSYESSEGRMAVIHTEDTTGTGLVMRDSNNEASGTSLTRSSRSETLRSLQSIYEQESGSLSRRRRVRFEIAEEERIDPQVRDELADLLDAKEAGVTYIIGHSYVKARKNSNFLKTFAIDYAYSFLRKNCRGPAVALHIPHISLVEVGMIYYV

SEQ ID NO: 4792 - protein, 334 aa, SYNECHOCOCCUS SP. WH 8102
MTRFPSTCSLDVVGIGNAIVDVLVQTDDAFLAQHGLQKGGMALIDEQQAETLYTASGPGLETSGGSVANTMVGIAQLGGRAGFIGRVRDDQLGGIFSHDIRAVGARFDTPAATTGATTARCLIYVTPDAERTMCTFLGASTQLEPEDLDLSMVRDTKVLYLEGYLWDSPAAKRAFIAAADVCREAGGQVALSLSDGFCVDRHRESFLELVNGHVDVLFANEVEIKSLYETDDFDTALKKVGGCCSVIAVTRGGEGSVVLSGDQRWDIGIFGLGELVDTTGAGDLYAGGFLHGYTQGESLGRCGQLGALCAGQIVTQLGARPQVSLRELAAAHLN

SEQ ID NO: 4793 - protein, 231 aa, Triticum aestivum
MAGASSWSSSCSCTSSLGSLDDDDVFCVVKPGSPGAAAEGSVKFLCSYGGMILPRHPDGALRYVGGNNRVLSVDRSLQFHELQRKLTDMCGWEALSLRCQLPTEDLDALVSVTTNDDLGHLLEEYDAASRDRLQPLKIRAFLFPRAKTPPLSPSTPSSRPTAGVRPPPPPAPHGSPPFGSWAFGPPAPTPAPAPPQRQSVAITAGLAAACWCISLAVVRSSMGRCAAVTDL

SEQ ID NO: 4794 - protein, 484 aa, Acinetobacter calcoaceticus
MSIFTKELWDKKLFNGSWQSAQDTYSVIEVATGQVLGEIGYATAADVVSAAQQAKAAQQQWWALNYQERQAVFERAAALLTENQAEVIEWLVKESGSLQLKAGFEVSIAIQVLKHCIASPTNEQGTLLPTQNGKLSIAKRLPLGVVGVISPFNFPLYLALRAVAPALAFGNAVVLKPDERTAVCSGYVIARIFELAGLPKGLLHVLPGGVEVGEALTLDQNIASIQFTGSTQVGRIVGANAAKTLKKVSLELGGKNSLIILDDADIELAAENIAWGAFLHSGQICMTSGKILIHQKIYQQVKQRVIEKVQNFVVGNPCDKNVTIGPLINAKQAQRVEQLVSAAVNEGATLEIGGHADGVFFQPTVLTDVTANNSIFSEEIFGPVAVLIPFSSDEQAIELANDGDYGLSAGIITSNVGRGMQLGAQLKVGLLHINDQTVNDETVNPFGGFGSSGNGTRIGGPANADEFTQWQWITVQAQAPHYPF

SEQ ID NO: 4795 - protein, 599 aa, Saccharomyces cerevisiae
MKITEKLEQHRQTSGKPTYSFEYFVPKTTQGVQNLYDRMDRMYEASLPQFIDITWNAGGGRLSHLSTDLVATRQSVLGLETCMHLTCTNMPISMIDDALENAYHSGCQNILALRGDPPRDAENWTPVEGGFQYAKDLIKYIKSKYGDHFAIGVAGYPECHPELPNKDVKLDLEYLSRRSTGGDFIITQMFYDVDNLLNWCSQVRAAGMDVPIIPGIMPITTYAAFLRRIQWGQISIPQHFSSRLDPIKDDDELVRDIGTNLIVEMCQKLLDSGYVSHLHIYTMNLEKAPLMILERLNILPTESEFNAHPLAVLPWRKSLNPKRKNEEVRPIFWKRRPYSYVARTSQWAVDEFPNGRFGDSSSPAFGDLDLCGSDLIRQSANKCLELWSTPTSINDVAFLVINYLNGNLKCLPWSDIPINDEINPIKAHLIELNQHSIITINSQPQVNGIRSNDKIHGWGPKDGYVYQKQYLEFMLPKTKLPKLIDTLKNNEFLTYFAIDSQGDLLSNHPDNSKSNAVTWGIFPGREILQPTIVEKISFLAWKEEFYHILNEWKLNMNKYDKPHSAQFIQSLIDDYCLVNIVDNDYISPDDQIHSILLSL

SEQ ID NO: 4796 - protein, 157 aa, Nicotiana benthamiana
VRAPCCEKMGLKKGPWTPEEDQILISFIQTNGHGNWRALPKQAGLLRCGKSCRLRWTNYLRPDIKRGNFTKEEEDTIIQLHEMLGNRWSAIAGKLPGRTDNEIKNVWHTHLKKKLKDYKPPQNSKRHSKNHDSKGPTTSRSSNNSDLTTQKHIDSPV

SEQ ID NO: 4797 - protein, 486 aa, Vibrio vulnificus CMCP6
MEVTAHYIGGKPFVGDTGESFATLNPATGEVLAHIEQADERVLGHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIDKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 4798 - protein, 472 aa, Gracilaria sp.
ESGVIPYAKMGYWDPDYVVKDTDVLALFRVSPQPGVDPVEASAAVAGESSTATWTVVWTDLLTACDLYRAKAYKVEAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLKVNLPQGIFFEQDWASLRKVTPVASGGIHCGQMHQLLDYLGNDVVLQFGGGTIGHPDGIQAGATANRVALESMVIARNEGRDYVAEGPEILRVAAKTCGPLQTALDLWKDITFNYTSTDTADFVETPTANV

SEQ ID NO: 4799 - protein, 660 aa, Oryza sativa (japonica cultivar-group); identical to SEQ ID NO: 4604

SEQ ID NO: 4800 - protein, 233 aa, Glycine max
  unsure (1)..(233): unsure at all Xaa locations
MPLLMKRAYTTSQIAIVGANPCPIESLDYXEISDNEILKNDWRSKKKVQTXSTYVMLKRGFALLTXRLGTGLVGFFNRAAVDNIAGFKLLMTTGLMSKHRYLDAFLAYAGANMCLAAAAAALCAFIAPAAAGSGIPEVKAYXNGVDAQNILAPSTLFVKIFWFHPXEFLLDFVVGKEGPMVHTGACIASLLGXGXGSHKYHLTCTWLRYFKNDRDRRDXXTCGAAALLPPFRA

SEQ ID NO: 4801 - protein, 358 aa, Schizosaccharomyces pombe
MGILDIVPTGVITGDNVLKLFTYAREHGFAIPAINVTSSSTAIAALEAAREARSPIILQTSNGGAHFFAGKESSNEGQKASIAGSIAAAHYIRSIAPFFGVPVVMHSDHCAKKLLPWMDGMFEADEAYFKIHGEPLFSSHMLDLSEEPKKENIAQVKEYCKRAVPMKIWIEMEIGITGGEEDGVDNSHVSHTELYTQPEDIWDVYRELSSVTPYFSIAAAFGNVHGVYKPGNVKLQPALLGQHQAYVKEQLKTTNDKPVFFVFHGGSGSSVNEFRTGIKCGVVKVNIDTDTQFAYVEGVRDYVLKYKDYLMTPVGNPEGADKPNKKKFDPRVWIHEGEKTMTKRVLTALEDFYTVNTL

SEQ ID NO: 4802 - protein, 427 aa, Nothocladus nodosus
IEASAAVAGESSTATWTVVWTDLLTACDLYRAKAYKVDAVPNTSDQYFAYISYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFAMEGVNRAQAATGEIKGHYLNVTAGTMEEMYERAEFSKQLGSVISMVDLVIGYTAIQSMAIWARKSDMILHLHRAGNSTYSRQKIHGMNFRVICKWMRMAGVDHIHAGTVVGKLEGDPLMIKGFYDTLLLSHLDVNLPLGIFFEQNWASLRKVTPVASGGIHCGQMHQLLDYLGDDVVLQFGGGTIGHPDGIQAGATANRVALESIVMARNEGRDYVNERPQILRDAAKTCGPLQTALDLWKDISFNYTSTDTADFV

SEQ ID NO: 4803 - protein, 463 aa, Sargassum obtusifolium
  unsure (1)..(463): unsure at all Xaa locations
MGYWDADYKVKETDILALFRITPQPGVDPVEAAAAVAGESSTATWTVVWTDLLTACDIYRAKAYRVDPVPGTNDQYFSYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATIENMYERAEYSHAIGSVICMIDLVVGYTAIQTMAIWARKAEMILHLHRAGNSTYARQKNHGINFRVICKWMRMSGVDHIHAGTVVGKLEGDPLMVRGFYNTLLLTELKINLAEGLFFDMDWASLRKCVPVASGGIHCGQMHQLLYYLGDDVVLQFGGGTIGHPDGIQAGATANRVALEAMVLARNEGRDYVGEGPEILRTAASTXGPLKAALDLWKDITFEYTSTDTPDFVEVATESP

SEQ ID NO: 4804 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLIAPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 4805 - protein, 494 aa, Medicago truncatula
MAASPAYQAHLPTSPEWLNKGDNAWQMTAATLVGLQSMPGLVILYASIVKKKWAVNSAFMALYAFAAVLICWVLVAYRMAFGDELLPFWGKGAPALGQKFLVARAKVPASTHYYKNGVDIETPMEEPFFPMASLVYFQFTFAAITMILLAGSVLGRMNIKAWMAFVPLWLIFSYTVGAFSLWGGGFLYHWGVIDYSGGYVIHLSSGIAGFTAAYWVGPRIKSDRERFPPNNVLLMLAGAGLLWMGWSGFNGGAPYAANVASSIAVLNTNICAATSLLVWTSLDVVFFGKPSVIGAVQGMMTGLVCITPGAGLVQSWAAIVMGILSGSIPWVSMMILHKKSSLLQKVDDTLGVFHTHAVAGLLGGLLTGLFAEPALCRLLLPVTNSRGAFYGGSGGMQLLKQLVAAMFVIGWNIVSTTIILLVIQLFIPLRMPDEQLEIGDDAAHGEEAYALWGDGEKYDPTRHGSLNTGNTGVSPYVNGARRCDYKFMSHNLQV

SEQ ID NO: 4806 - protein, 379 aa, Neurospora crassa
MLALRSIAAPAQRQAFRAAPRAVSVSFQNRFYSSRVAQFTGQKDASGKYTVSLIEGDGIGPEIAVAVKDIFAAAQTPINWEPINVDPILKDGKTAIPDAAIESIRRNKIALKGPLATPIGKGHVSLNLTLRRTFNLFANLRPCRSVAGFKTPYDGVDTVLIRENTEGEYSGIEHVVVDGVVQSIKLITREASERVLRYAFEQARAINRKKVRVVHKATIMKMSDGLFLNTAREVAQDFPDIEFDAELLDNTCLKMTTDPTPYNDKVLVMPNLYGDILSDMCAGLIGGLGLTPSGNIGDECSIFEAVHGSAPDIAGKGLANPTALLLSSMMMLRHMGLNEYADKIEKAAFDTLAEGKVLTGDLGGKASTKDFTSAIIDRL

SEQ ID NO: 4807 - protein, 158 aa, Glycine max
NLIFTPRSASDSYGTATYYRHVRDPSSDGFAEIMMLQGSLLMGGQLNSHDHFKDWRLDVDNMSYEQLLELGERIGHVNTGLKEDEMGRNIRKTRIQFWDDTSKLQVDKECSICQEEYEAREELGRLNCEHSYHFQCIKQWVAQKNFCPVCKQQVAARH

SEQ ID NO: 4808 - protein, 364 aa, Ricinus communis
MRGGILLSVLLLATCQFSLSIRDGLVKNGNFELAPKPSDMKGTQVIGKNAIPEWEISGFVEYIKSGQKQGDMLLVVPEGAYAVRLGNEASIKQRMRVIKGMYYSITFSAARTCAQEEKLNVSVSPDWGVLPMQTMYSSNGWDSYAWAFQAEFQYVDLVIHNPGVEEDPACGPLIDSVAIRALYPPRPTNKNILKNGGFEEGPYVFPNTSWGVLIPPNIEDDHSPLPGWMVESLKAVKYIDVDHFSVPQGRRAIELVAGKESAIAQVARTVIGKTYTLSFAVGDASNSCEGSMVVEAFAGKDTLKVPYESKGKGGFKRAVLRFVAVANRTRIMFYSTFYTMRSDDFSSLCGPVLDDVKLLSVRKP

SEQ ID NO: 4809 - protein, 169 aa, Triticum aestivum
  unsure (1)..(169): unsure at all Xaa locations
IGKKAAYALSQNLKVMACIGELLEEREAGKTXDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPXFAXICNSXTSXKVXACTPPMVEISDEKRQPGYRVEKA

SEQ ID NO: 4810 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAADLTKRIQNAGTEVVEAKAGGGSATLSMGQAAARFGLSLVRALQGETGVVECAYVEGDGQYARFFSQPLLLGKNGVEERKSIGTLSAFEQRSLEG

SEQ ID NO: 4811 - protein, 332 aa, Brucella melitensis 16M
MKTGRTDRPRILIVSTGGTIASRYDPQTDSLLSVSTGKELLSSLGALAPAVDVVLDEFCNLGSNRIDLDTSFRLAHHIDERLRDRTVDGCVVTHGTDTLEESAFLAQLTISSRKPVVFTGAQRSADEPDADGPRNLADAISVAASPEARDLGTLVVFAGKVLSSIDATKIHTSKLEAYDAPGYGPLGVVDHGAVFITRKPLGYPMIAAHSIETRVDLITLAMGADGRLIEAAINSGTHGFILETFGRGNATPAVVDAIARATERGIVTIITSRCPDGRVLPVYGDGGGSDLEKAGAIFAGRLNGPKARILLCLSLPTIPVEELGRLFEQFGR

SEQ ID NO: 4812 - protein, 394 aa, Amycolatopsis orientalis
MNRVLSALAPHSSKRISEYAQRHPGTVDLTVGLPAFGPPRSFDERLAMLSSAPHVNARPEDQYAHSRGAIELRAAIAHVYKSEQGVDLDPDTQILVTNGAAGALWIAVLTLTEPGDEVLLADPGYMIYPPMIELLGRRVVRIPTSPADGFRLHLSDLRSRLTQRSRVVLVNSPGNPTGRVSSEDELADLCAFAVEHGLYVVHDEVLDRFAYGIEHRSVVALDHQGVGIAVNGLSKRFGMSGWRIGWLASSSAVIAEAAKAHTFFMLAVSHAVQLAAAAALSDPKADGEVSVYAAEIRRRGEVFLADLARIPGLGKTTVPDGGFYAFVDVGEFARLRGIRVAESTSAAVAEYLLHECGVAVVPGSVFGRAGEGFVRMSFAGSAEQLDRAVKRLAG

SEQ ID NO: 4813 - protein, 84 aa, Glycine max
  unsure (1)..(84): unsure at all Xaa locations
MAKHHPDLIMCRKQPGIAIGRLCEKCDGXGRCVICGGVGISDAYYCKECTQQEKDRDGCPKIVNLGSAKTDLFYERKKYGFKKR

SEQ ID NO: 4814 - protein, 452 aa, Amycolatopsis balhimycina
MLHTFAAAVAPVAPIAAHSLLVFLLQIGLLLLLAVVLGRLAGRFGMPAVVGELFVGVILGPSLLGWAAPGLHSWLFPAVAEQYHLLDAVGQVGVLLLVGLTGVQMDMGLARKRGLTAAGVSIGGLVLPLGLGIGAGYLLPKVLVPEGTDVTVFAMFLGVALCVSAIPVIAKTLIDMKLLHRNIGQLTLTAGMVDDVFGWFMLSVVSAMAVNAVSAGTVLTSLAYLVAILAFCFTLGRPLARGVLRVAAKSDGPGLTVATVVVLIFLAAAGTQALGLEAVFGAFLCGILLGTAGKVDPAKLAPLRTVVLSGLAPLFFATAGLRMDLTALTHPVVLLTGLVVLALAIAGKFAGAFAGARLSGLNKWEGLALGAGLNARGVIQVVVAMVGLRLGILSVEVYTIIILVAIVTSLMASPILRFAMSRVEQTAEEQVRENEHRAWNTHPAANPQEQSL

SEQ ID NO: 4815 - protein, 390 aa, SYNECHOCOCCUS SP. WH 8102
MATLLDQLSAMTVVVADTGDLEAIRKFTPRDATTNPSLILAAAQIPAYQSLIDEALRSSRKLIGDAAPVEDVVHEALDEISVIFGKEILKIVPRRVSTEVDARLSYDTDATIEKGRKLIRLYNDAGISNDRVLIKIASTWEGIKAAEVLEKEGIHCNLTLLFGFGQAVACAEAGVTLVSPFVGRILDWYKADTGRDSYPGPEDPGVISVTRIFNYYKTYGYKTEVMGASFRNLDEITELAGCDLLTISPKLLDQLRESDASLSQKLDATNPSGGEEQIHVDRERFDAMMAADRMATDKLGEGIKGFSKAIETLEHQLAHRLAELEGGEAFRHAVQEIFMLNDMNGDGCITRDEWLGSDAVFDALDLDHDGRLTPEEVRKGFGAALTLTTA

SEQ ID NO: 4816 - protein, 556 aa, ASPERGILLUS NIDULANS FGSC A4
MADKVQADEPQIQPESSIPDSRSSLKGDAHHAEVSRQPYGPPGLRGVVANPFVLLCAACSTLGGLSFGYDQGVISVTLVMEQFLGRFVEVAEGHPGSGFWKGLMTAMLELGAFVGALNQGWLADKISRRYSIVVAVAIFNVGSVLQTAAVDYAMLTVGRTIGGIGIGMLSMVAPLYISEVSPPECRGALLVLEEFCIVLGIVIAYWITYGTRFMAGEWAWRLPFLLQIVPSFVLLGGVIVLPFSPRWLASKGRNDEALQSLSQLRRLPTTDHRIQQELLDIKIDVRFHQELNAEKHPTLQGSGTTKSLLRELAGWADCFKSGCWRRTQVAVLVMFFQQFVGINALIYYSPTLFKTMGLDYDMQLLMSGIINVTQLVGVCTSLWTMDALGRRPLLLWGAAIMGISHVIIAALVGIYSDNWPAHRTRGWTSVAFLFVYMLAFGATWGSVGWALPAEVFSSFLRAKGVALATCGTWLFNFIIGLITPPLIQDTGYGAYVFFAVFCILAFIWTFFCVPETSGRTLEQMDAVFKDNSISAERARRQAIENELMGEHHGVTA

SEQ ID NO: 4817 - protein, 259 aa, Brevibacillus brevis
MVKSKYLVFISVFSLLFGVFVVGFSHQGVKAEEERPMGTAFYESFDAFDDERWSKAGVWTNGQMFNATWYPEQVTADGLMRLTIAKKTTSARNYKAGELRTNDFYHYGLFEVSMKPAKVEGTVSSFFTYTGEWDWDGDPWDEIDIEFLGKDTTRIQFNYFTNGVGGNEFYYDLGFDASESFNTYAFEWREDSITWYVNGEAVHTATENIPQTPQKIMMNLWPGVGVDGWTGVFDGDNTPVYSYYDWVRYTPLQNYQIHQ

SEQ ID NO: 4818 - protein, 333 aa, Zea mays
  unsure (1)..(333): unsure at all Xaa locations
MMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPXQLIPARPXKERCSCXLIXKKGXKNFXPVIFLPRIDXXWVPWEELQLLPGSFHGRYEQVCLEHRRLTT

SEQ ID NO: 4819 - protein, 359 aa, Borrelia burgdorferi B31
MGVLDKIKPGVVYGKELHFLYEICKKEGFAIPSINCIGTNSINAVLEAAKEINSPIMIQFSNSGSAFISGKGLKMEKPQGVSIVGAISGAMHVHLMAEHYGVPVVLHTDHCAKNLLPWVEGLLEYGEKYYSQHKKPLFSSHMLDLSEEPIKENIEISKKFLERMAKIEMFLEIELGITGGEEDGVDNSDRALHELFSTPEDIYYGYSELLKVSPNFQIAAAFGNVHGVYKPGNVKLTPKVLKDGQDYVISKTGVNMAKPVSYVFHGGSGSTIDEINEALSYGVVKMNIDTDTQWAAWEGVLNYYKKNESRLQGQLGDGKDIDIPNKKFYDPRVWLREAEVSMKDRVKIACKNLNNINRN

SEQ ID NO: 4820 - protein, 391 aa, Glycine max
MEGGGAAPPADTVMSDAAPPPQQAMAMGIENIPATLSHGGRFIQYNIFGNIFEVTAKYKPPIMPIGKGAYGIVCSALNSETNEHVAIKKIANAFDNKIDAKRTLREIKLLRHMDHENVVAIRDIVPPPQREIFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCMTPFNFDFEQHALTEEQMKELIYREALAFNPEYQQ

SEQ ID NO: 4821 - protein, 256 aa, Selaginella remotifolia
ETWLVTTTSSSNPEVGLATGLAATGGAQDLLNPPLNKQKEPPVGRGKIEIKRIENATSRQVTFSKRRGGLLKKAHELSVLCDAQVALIIFSSTGKLFEYASTSMKEILDRYGKYPESVQGGNMASHHEASDFISHEIRRLKQQLQRSQQSRRHLLGDDLSHLPIKDLQNLEQQLEVGLSRVRSRKDQVLMDQVDELRRRELTLHKDNEMLRRRLSDVQGMAESGRSTLIVNPWRQGNLLQTWQMYPCHFLDTKAAA

SEQ ID NO: 4822 - protein, 336 aa, Streptococcus thermophilus
MVVKVGINGFGRIGRLAFRRIQNVEGVEVTRINDLTDPVMLAHLLKYDTTQGRFDGTVELKDGGFEVNGKFVKVSAERDPEQIDWANDGVEIVLEATGFFTKKVLAEKHLHPGGAKKVVITAPGGNDVKTIVFNTNHDILDGTETVISGASCTTNCLAPMAKALNDNFGIVEGLMTTIHAYTGDQMILDGPNRGGDLRRARAGAANIVPNSTGAAKAIGLVIPELNGKLDGSAQRVPVPTGSVTELVAVCEKNVTVDEVNAAMKAATNESYGYTEDPIVSSDIVGMSYGSLFDATQTKVLDVDGKQLVKVVSWYDNEMSYTSQLVRTLEYFAKIAK

SEQ ID NO: 4823 - protein, 368 aa, Hordeum vulgare subsp. vulgare
MNCNFNSDLLEKEAGRTSFPWARPCDGCHAAPSAVYCCADAAYLCSSCDTQVHSANRVASRHERVRVCETCESTPAVLACHADAAALCTACDAQVHSANPIAQRHQRVPVLPLPAVAIPAASGFAEAEASVTAHGDKEGGEEVDSWLLRRNSDDNNCANKIDRYFNLVGYNMYYDNITCDPRPQEQYRMQEQQHVQNRYREKEGCECVVPPQVVMASEQQGSNYGTIGAGQAASVTAMASTYTASISNDISFSSMEVGIVPDNTRPNISNRNILTSSEAIELSGHSLQMPVHFSSMDREARVLRYKEKKQARKFQKTIRYATRKAYAEARPRIKGRFAKRSDIEHEENHMLSPPALPDTSSYNTVPWF

SEQ ID NO: 4824 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 4825 - protein, 361 aa, Triticum aestivum
  unsure (1)..(361): unsure at all Xaa locations
MWGTAANLRRNIEGSTEANMPNVKSAGGAGASASPAGGDGEVEAGFAKMQGVDFEYYMQTYSSMLPRNSEKSKVDVDLSCLGGGMNISRHHARIFYDFQRRRFALDAIGXNGCLVEGVLHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSPIEAKGRPWYGLLGLLRKYPEHFVINTKSKGRAISEFVSLVSLLS

SEQ ID NO: 4826 - protein, 91 aa, Fragaria x ananassa
MMMISLLVFNPVEADGVVVNYGQHASLLAKIDCGGACKARCRLSSRPHLCKRACGTCCQRCSCVPPGTAGNYDVCPCYATLTTHGGKRKCP

SEQ ID NO: 4827 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHAGFGIKPCSEKXXXXXXRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 4828 - protein, 355 aa, Dianthus caryophyllus
NSTKIAPSRVETLASSGIECIPKEYVRPEEELTSIGDVFEEEKKDDGPQVPTIDLKDIASEDPEVRAKAIHELKKAAMEWGVMHIVNHGISEELINRVKVAGETFFEFPIEEKEKYANDQDSGNVQGYGSKLANNASGQLEWEDYFFHLAYPEEKRDMSIWPKSPEDYIPAVSEYSKELRSLATRIFSALSVALGLEEGRLEKEVGGLEELHLQMKINYYPKCPQPELALGVAAHTDVSALTFILHNMVPGLQLFYEGKWVTAKCVPNSIIMHIGDTIEILSNGKYKSILHRGLVNKEKVRISWAVFCEPPKEKIILKPLLDLVNESDPAQYPPRTFAQHIQHKSSERLRMSNPQ

SEQ ID NO: 4829 - protein, 329 aa, Pyrobaculum aerophilum str. IM2
MLPPPAGVLKLDQNEVPIPPPSHVVEAAAQALAVSNWYQPAALYDEVRGLYAEYAGVDPKYVWLFPGADDFFEPLLRTARAVAVPSPTYFLFEDQAQFHGASLVKTPLRGEEFRLDLAEFLDAARRADAVYLDNPNNPTGQLLLKPVEVEEVLALGKPTIIDEAYFEFSGATVANLVESWPNLAVVRTMSKAFLLAGLRVTPVIAGRGWRIHYNTVRFRVSLPSLAAARAALYKRDYVAEVVRQIREGARYLKEELSRLGVKTWPTYANFILARGPPGFAQALRKYGVWVRDEEARLGPGYVRITIGTEEVNAQLIRTIRTILALPTPF

SEQ ID NO: 4830 - protein, 275 aa, Glycine max
  unsure (1)..(275): unsure at all Xaa locations
SRLIRLSGYCNLDWGTEXTKDADRNGPKGIISAVGISIVVGWGYILGITFAVTDILYLLSEDNDAGGYAIAQVFYQAFKKRYGHGTGGIICLVIVAVAIFFCGMSSVTSNSRYINVLPLSAFFIDGAMNFSXISLWHIVNKQEVPIYAVWLSVFISFCMALTSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 4831 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 4832 - protein, 215 aa, Bacillus licheniformis
MQTGGSFFEPFNSYNSGLWQKANGYSNGDMFNCTWRANNVSMTSSGEMLLALTSPSYNKFDCGENRSVQTYGYGLYEVRMKPAKNTGIVSSFFTYTGPTDGTPWDEIDIEFLGKDTTKVQFNYYTNGAGNHEKVADLGFDAANAYHTYAFDWQPNSIKWYVDGQLKHTATSQIPTTPGKIMMNLWNGIGVDDWLGSYNGVNPLYAHYDWVRYTKK

SEQ ID NO: 4833 - protein, 337 aa, Pseudomonas sp. ATCC29598
KEVENQQKLANVVILATGGTIAGAGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRLTPALQTLRKTGTQIIRSSHVNQGGFVLRNAEQPDDKNDWVVAHDLNPEKARILVELAMVKTQDSKELQRIFWEY

SEQ ID NO: 4834 - protein, 573 aa, Buchnera aphidicola
MEMLSGSEMGIQSLIDQGIKYIFGYPGGAVLDIYDSLKSTNKIKHILVRHEQGATHMADGYARATGKVGVVLVTSGPGATNAITGIATAYMDSIPIVVISGQVASYLIGYDAFQECDMIGISRPIVKHSFLVKKTEDIPITFKKAFWLASSGRPGPIVIDLPKDILNSCKKKPYVWPTKINIRSYNPIIKGHFGQIKKAIDALKLAKQPIIYVGGGVISSNSYNELKEFAERLNIPVTTSLMALGAFPGNHPQNLNMLGMHGTYEANMAMHNSDLILAIGVRFDDRTTNNVDKYCPNATIIHIDIDPTSISKTITAHIPIIGNAKNILQQMLQLINDSMFVKELYCLKKWWIKINHWKSMNSLHINIDNVKIKPQSVIKTIWKLTKGEAYIASDVGQHQMFAALYYSFQKPRRWINSGGLGTMGFGLPAALGAKLALPKKTIICITGDGSIQMNIQELSTAMQYELPILILNLNNRSLGMVRQWQDIIYSGRHSHSYMKSLPNFVQLAESYGHIGIYIEHPKDLEKKLRIALEQLKKGHLVLVDVIIDASEHVYPMQIRGGGMNSMILRKNGK

SEQ ID NO: 4835 - protein, 506 aa, Antirrhinum majus
MSTLVYSTLFILSTLLLTLLTRTRRKTRPPGPLALPLIGHLHLLGPKLHHTFHQFSQRYGPLIQLYLGSVPCVVASTPELAREFLKTHELDFSSRKHSTAIDIVTYDSSFAFAPYGPYWKFIKKLCTYELLGARNLSHFQPIRALEVNSFLRILYEKTEQKQSVNVTEELVKLTSNVISNMMLGIRCSGTEGEAEVARTVIREVTQIFGEFDVSEIVWFCKNLDLQGIRKRSEDIRRRYDALLEKIISDRERLRLRGGGGGGGGEVKDFLDMLLDVMESEKSEVEFTREHLKALILDFFTAGTDTTAITTEWAIAELISNPNVLKKAQEEMDKVIGSQRLLQESDAPNLPYLNAIIKETFRLHPPIPMLTRKSISDVVVNGYTIPAKTLLFVNLWSMGRNPNYWENPMEFRPERFLEKGTGSIDVKGQHFELLPFGTGRRGCPGMLLGMQELFSIIGAMVQCFDWKLPDGVKSVDMTERPGLTAPRANDLVCQLVPRIDPVVVSGP

SEQ ID NO: 4836 - protein, 215 aa, GIBBERELLA ZEAE PH-1
MSAQDPLSSTNPSSVTNNTQDASGRQPSSAAAGSSELSSAKISLRKSLRSFPDFPIPGINFVDIMPLFADPTAHATLVEALELQIAEAFPTKPDVIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 4837 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPTEHNWPGISQFPEYKATAPRYATQDLRQILPQIDATGIDLLQRLLQLRPELRISAHDALQHPWFHDILQYQHCQQAAG

SEQ ID NO: 4838 - protein, 516 aa, Pisum sativum
MASMAAIGVLKVPPSSSSSSSSSSSSSKAIARNLSFTSSQLCGDKIFTVSGTRRSSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVASLPMDEARATAFGLMKIDEEGRIVEFSEKPKGEQLKAMKVDTTILGLDDERAKEMPYIASMGIYVVSKHVMLDLLRDKFPGANDFGSEVIPGATELGLRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIKRAIIDKNARIGDDVKIINSDNVQEAARETEGYFIKSGIVTVIKDALIPSGTVI

SEQ ID NO: 4839 - protein, 426 aa, Triticum aestivum
  unsure (1)..(426): unsure at all Xaa locations
KEMIVSMAVAGAIIGAAVGGWANDRFGRRTSILVADLLFFAGAVVMASATGPVQLVVGRVLVGLGVGMASMTAPLYISEASPARIRGALVITNGFLITGGQFLSYLINLAFTKAPGTWRWMLGVAGLPAVFQFVLMLFLPESPRWLYRKGRVEEAEAILRKIYTAEEEVTREMQELKESVEAEARERGSSERVSLTALVKTPTVRRALVAGVGLQVFQQLVGINTVMYYSPSIVQLAGFASNQTALALSLVTSGLNALGSIVSIYFIDRTGRRKLLVISLVGVIASLALLSAVFHQDHHTLARRRQAPRPDTSMAPSHARATGRAAPAGTAPGASRPSSTGCGFCASGAGKQAAPGRVPAVERDGARRVPRRGATVVHARLPEPIRLAGDVRAGSVHRLLLPREMGHGXLDRQLKRXNRWRXPRVF

SEQ ID NO: 4840 - protein, 358 aa, Desulfovibrio desulfuricans G20
MEMRICLLAGDGIGPEIMEQGVRVLETVAGKFGHDMEFTDALIGGAAIDETGDPLPQETVEACKAAQAVLLGAVGGPRWDNLTGAERPEAGLLGIRKALGLFANLRPAKLFPELASACFLRPDIVANGIDVMVVRELTGGIYFGTPAGEETRDGLRTAFNTMVYNEEEVRRIARVAFEAARKRSGRVCSVDKANVLAVSRLWREIVTATHADEFPDVELSHMYVDNAAMQLVRDPSQFDVIVTGNLFGDILSDEASVITGSIGMLPSASLGAGGPGLFEPIHGSAPDIAGQNKANPLATILSTAMMLRHSFGLEKEAEAVEGAVQQVLKAGYRTGDIMDQGGTLVGCNTMGNLVNERI

SEQ ID NO: 4841 - protein, 383 aa, Zea mays
MSPTEEAAGGGGDDYDRLSELKAFDDSKAGVKGLVDAGVTTIPAIFRGHLLQEGPKVSSSSSSSSTSLSIIPVIDLSAADAVAREEVVAQLKAAAETVGFFQLVNHGVPSELLCEMLASVRRFNEEPHEVKRPYYTRDARRKVRFNSNFDLFQSPAANWRDTLFCEAAPEPPRAEELPVAVRHVMLEYGGAVREVAARVLGLLSEALGLSPGHLAGMGCAEGLSLVCNYYPPCPEPDLTLGCSRHSDPSFLTVLLQDSHAQGGLQALLASRWLDVPPVAGALLVNVGDLLQLVSNGRFKSVEHRVVANRSRDTARVSVACFCNADIARSTRLYGPIAELIAADDSDGAGRALYRNVTVPEFLAHYDKKGLDGRPALHRFQLLQ

SEQ ID NO: 4842 - protein, 63 aa, Brassica napus
MRGILVDWLVEVSEEYTLVPDCVYLTVYLIDWFLHGKYLERQRLQLLGITCMLIASKYEEIYP

SEQ ID NO: 4843 - protein, 552 aa, Oryza sativa
  unsure (1)..(552): unsure at all Xaa locations
MAAASSAPFFGLGDTQMPPPQNPTNPALHQQPNPSPAPVAAAAPAPKKKRNQPGNPNPDAEVIALSPRTLMATNRFVCEVCNKGFQREQNLQLHRRGHNLPWKLKQKNPKEARRRVYLCPEPSCVHHDPSRALGDLTGIKKHYCRKHGEKKWRCDKCSKRYAVQSDWKAHSKTCGTREYRCDCGTLFSRRDSFITHRAFCDALAQENARMPPIGAGVYGGAGNMTLGLTGMAAPQLPAGFPDQAGQPSASAGDVLRLGGGSNGASQFDHLMASSSGSSMFRSQGSSSSSFYLANGAAHHAPAQDFGPEDGQSQAGQGSLLHGKPAAFHDLMQLPVQHQQSGNGNLLNLGFFSGSNGGVDQFNGGAGNGGQGSIVTSSGLAGNHGGGGGGFPSLYNSSEPAGTLPQMSATALLQKGLPRWVQRRAATNAGGAGGASSLLRGASSHGISVGEGPANERSSYQNLIMGSMASGGGGAGFAGSFSGASGFGGPRRRRQAXTRDFLGVGGRPGHQRLGGNGAAAPWRGRPPRRLTGPGKHELKSSQRRKKTIEDGRR

SEQ ID NO: 4844 - protein, 404 aa, Oryza sativa (japonica cultivar-group)
MAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHLMFPAIRIGVVSERQSIPF

SEQ ID NO: 4845 - protein, 1115 aa, Gibberella moniliformis
MSATALFTRRSVSTSNPELRPIPGPKPLPLLGNLFDFDFDNLTKSLGELGKIHGPIYSITFGASTEIMVTSREIAQELCDETRFCKLPGGALDVMKAVVGDGLFTAETSNPKWAIAHRIITPLFGAMRIRGMFDDMKDICEQMCLRWARFGPDEPLNVCDNMTKLTLDTIALCTIDYRFNSFYRENGAAHPFAEAVVDVMTESFDQSNLPDFVNNYVRFRAMAKFKRQAAELRRQTEELIAARRQNPVDRDDLLNAMLSAKDPKTGEGLSPESIVDNLLTFLIAGHETTSSLLSFCFYYLLENPHVLRRVQQEVDTVVGSDTITVDHLSSMPYLEAVLRETLRLRDPGPGFYVKPLKDEVVAGKYAVNKDQPLFIVFDSVHRDQSTYGADADEFRPERMLKDGFDKLPPCAWKPFGNGVRACVGRPFAMQQAILAVAMVLHKFDLVKDESYTLKYHVTMTVRPVGFTMKVRLRQGQRATDLAMGLHRGHSQEASAAASPSRASLKRLSSDVNGDDTDHKSQIAVLYASNSGSCEALAYRLAAEATERGFGIRAVDVVNNAIDRIPVGSPVILITASYNGEPADDAQEFVPWLKSLESGRLNGVKFAVFGNGHRDWANTLFAVPRLIDSELARCGAERVSLMGVSDTCDSSDPFSDFERWIDEKLFPELETPHGPGGVKNGDRAVPRQELQVSLGQPPRITMRKGYVRAIVTEARSLSSPGVPEKRHLELLLPKDFNYKAGDHVYILPRNSPRDVVRALSYFGLGEDTLITIRNTARKLSLGLPLDTPITATDLLGAYVELGRTASLKNLWTLVDAAGHGSRAALLSLTEPERFRAEVQDRHVSILDLLERFPDIDLSLSCFLPMLAQIRPRAYSFSSAPDWKPGHATLTYTVVDFATPATQGINGSSKSKAVGDGTAVVQRQGLASSYLSSLGPGTSLYVSLHRASPYFCLQKSTSLPVIMVGAGTGLAPFRAFLQERRMAAEGAKQRFGPALLFFGCRGPRLDSLYSVELEAYETIGLVQVRRAYSRDPSAQDAQGCKYVTDRLGKCRDEVARLWMDGAQVLVCGGKKMANDVLEVLGPMLLEIDQKRGETTAKTVVEWRARLDKSRYVEEVYV

SEQ ID NO: 4846 - protein, 161 aa, Triticum aestivum
  unsure (1)..(161): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASXPGYYDGRYWTMWKLPMFXGCTDATQVINEVEEVKKGVPLXRTFRLLXSKTCARVQC

SEQ ID NO: 4847 - protein, 353 aa, Haemophilus influenzae Rd
MKLSKTFLFITALCCATPTLAIQNSTSSSGEQKMAMENTQNIREIYLAGGCFWGMEAYMERIHGVKDAISGYANGNTEKTSYQMIGLTDHAETVKVTYDANQISLDKLLKYYFKVIDPTSVNKQGNDRGRQYRTGIYYQDGADKAVIGQALAQLQTKYKKPVQIEVQPLKNYIVAEEYHQDYLKKNPNGYCHIDITKADEPVIDEKDYPKPSDAELKAKLTPLQYSVTQNKHTERSFSNEYWDNFQPGIYVDITTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 4848 - protein, 205 aa, Triticum aestivum
  unsure (1)..(205): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXTMWKLPMFGXCTDATQVINEVEESRRSXPDAYVPHIGFDNMXQVQCVSSSASSNGLQDPARLNTNHTGNINAMRFALMLWFFHYLLLSR

SEQ ID NO: 4849 - protein, 307 aa, Streptomyces lividans [sequence omitted]

SEQ ID NO: 4850 - protein, 324 aa, Bacillus anthracis str. A2012
MKRILVLHTGGTIAMEEDKETGVVQPGEKNPLLKFIPDLEGDVDLIVEDVFHLPSPHMTPSEMLQLQVIIDERVKQDNIHGVVITHGTDTLEETAYFLDLTVQATIPIVVTGAMRSSNELGADGLYNFLSAVKVASSSEAAEKGVLVVLNDEIHCATNVTKTHTSNVATFQSPQYGPIGMVTKRGVVFHHALVHHETYSVNKVSKNVVVLKAYAGMDDTLLAAIENLPVDGIVIEALGQGNLPPRTLPSLERLINKGIPVVLVSRCFNGIVQDVYSYEGGGKQLKDMGIVFTYGLNAQKARIKLLVALENTTSHEAIQNMFMHD

SEQ ID NO: 4851 - protein, 231 aa, Thermosynechococcus elongatus BP-1
MSAKPVVIAPSILSADFSRLGEEIQAVDRAGADWIHVDVMDGRFVPNITIGPLIVEAIRPLTQKPLDVHLMIVEPEKYVADFAKAGADIISVHAEHNASPHLHRTLCQIRELGKQAGVVLNPSSPLELIEYVLEVCDLVLIMSVNPGFGGQKFIPAVLPKIRRLRQLCEERGLDPWIEVDGGLKVDNTWQVLEAGANAIVAGSAVFNAPDYAAAIAGIRNSKRPSPELVTA

SEQ ID NO: 4852 - protein, 215 aa, Oryza sativa
ELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 4853 - protein, 480 aa, Geobacter metallireducens
MKEYRLFINGEWVPSSTGTMADDINPATGDVYAKVHQASRDDIEQAIASAYRARVDWGKTVPAQREAILIKAAAILEERIPEFAEVLIEEGGATFGKAMFESSFVVTLLRSAAGECRRIFGETIPSDAPGLFSMSVRRPLGVIAGISPFNFPFLLAMKKVALALAAGNTFVLKPASPTPVIGLKIAELFEAAGLPKGVLNVIPVKGSTLGNTLVEDPRIRMVTFTGSTDVGKQLAEVAGRHQKKITLEMGGKSPLIVLKDADIDYAVDAAVFGIFLHQGQVCMANSRLIVEADIYDRFCEKLTAKVKGLKMGDPHKPDTVIGPLIDAKQCAFIDSQVHDALADGARVLSGGRSEGAFYQPTIVADVTRKMRIFDEESFGPVVCVIKAANSEEALALANDSSFGLSAGLITNDLQKAFDLSLRLESGMVHINDSSIFDEPHVPFGGVKDSGVGREGGHYSMEEMTEVKWITVQMGKRQFPF

SEQ ID NO: 4854 - protein, 488 aa, Acrothrix pacifica
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGPPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 4855 - protein, 253 aa, Zea mays
  unsure (1)..(253): unsure at all Xaa locations
MSPEAGPIMRPADQLLLPFLLLAVASVAAAGGSWENGYGSILRLPSSSPRRFPRSAAVDLIHALNLHPADASPPLSTAGVEGALAPAGTLVERPIRIASFANGGAATSVEDLGHHAGYYRLANTHDARMFYFFFESRGHKDDPVVIWLTGGPGCSSELALFYENGPFNIADNLSLVWNDFGWDKASNLIYVDQPTGXTGFSYSSDSRDTRXEATISNDLYDFLQAFFAEHPXYAXNDFFLTGESYAGHYIPAF

SEQ ID NO: 4856 - protein, 221 aa, Zea mays
MSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALALAILFILYFKLAH

SEQ ID NO: 4857 - protein, 358 aa, Thunbergia alata
TILREVETANKHFTPPSEVHVQVTHSMPPQKIEIFKSLEDWAADNILVYLKPVEKCWQPQDFLPDPASDGFHDQVKELRERAREIPDDYFVVLVGDMITEEALPTYQTMLDTLDGVRDETGASPTPWAIWTRAWTAEENRHGDLLNKYLYLSGRVDMRQIEKTIQYLIGSGMDPRTENSPYLGFIYTSFQERATFISHGNTARLARQHGDNKLAQICGTIASDEKRHETAYTKIVEKLFEIDPDGTMLSLADMMKKKVSMPAHLMYDGHDENLFENFSAVAQRLGVYTAKDYADILEHLIARWKVSDLTGLSGEGQKAQDYVCRLPPRIRKLEERAQARIKEGPRIPFSWIYNRELLL

SEQ ID NO: 4858 - protein, 388 aa, Salmonella enterica subsp. enterica
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 4859 - protein, 777 aa, Phragmites australis
MSLEVERPGGTESTNRLSLKRHDSLFGDAEKVSGAKHHGSEVSWSRTLHLAFQSVGIIYGDIGTSPLYVYSSTFPSGIKNNDDLLGVLSLIIYTLIIIPMLKYVFIVLYANDNGDGGTFALYSLISRYAKIRLIPNQQAEDAMVSNYSIETPSSQLRRAQWVKQKIVSSKAAKIALFTLTILGTAMVMGDGTLTPAISVLSAVSGIREKAPSLTQTQVVWISVAILFMLFSVQRFGTDKVGYTFAPVISVWFLLIAGIGLYNLVVHDIGVLRAFNPMYIVHYFKRNGKDGWVSLGGVILCVTGTEGMFADLGHFNVRAVQISFTGILFPSVALCYIGQAAYLRKFPENVGDTFYRSIPAPLFWPTFIVAICAAIIASQAMLSGAFAILSKALSLGCLPRVRVIHTSKKYEGQVYIPEVNFMMGLASIIVTIAFRTTTSIGNAYGICVVTTFSVTTHLMTLVMLLIWKKHIVFILLFYVVFGFTELIYLSSILSKFIEGGYLPFCFAVVLMTLMATWHYVHVKRYWYELDHVVPTNEMTTLLEKNDVRRIPGVGLLYTELIQGIPPVFPRLIKKIPSVHSIFVFMSIKHLPIPHVVPAERFLFRQVGPREQRMFRCVARYGYSDRLEESKEFAGFLADRLKMFIQEESAFAQNEAENDESSPSTEVPEAQTRPWRSTHSVVHSEEAIHPRVSSHSGRITFPANHSVEEEKQLIDREVERGVVYLMGEANVSAGPKSSILKKIVVNYIYTFLRKNLNEGHNALSIPKDQLLKVGITYEI

SEQ ID NO: 4860 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 4861 - protein, 256 aa, Oryza sativa
MSTAVADVPPAAAYGFPGSAKRGKPEEVVVLMGKRRNEGFFIEEEEEEEEVLTESSSIGAPSPASSSIGENSGEEEGGDDEEEVESKLKAEDEQVGLGCLDALEESLPIKRGLSNFYAGKSKSFTSLAEATASPAAAANELAKPENPFNKRRRILATWSRRASCSSLATATYLPPLLAPDHAVAEGDEGEEEDDDSDDDERQHRGKNGGRRESAAPPLPLPPPRLTLHTQMGGMLEQKAIDLLLAGRVVTATTAYY

SEQ ID NO: 4862 - protein, 298 aa, Cryptococcus neoformans var. neoformans
MSLDNYQKIEKVGEGTYGVVYKAKDINTGHIVALKKIRLEAEDEGVPSTSIREISLLKELSKDDNIVKLLDIVHSEAKLYLVFEFLDMDLKKYMDTIGEKDGLGPDMVKKFSYQLVKGLYYCHGHRILHRDLKPQNLLINKSGDLKIGDFGLARAFGIPLRTYTHEVVTLWYRAPEVLLGSRHYSTAIDMWSVGCIVAEMATRQPLFPGDSEIDEIFRIFRVLGTPDEDVWPGVRGLPDYKPTFPQWHPVELADVVKGFEADGLDLIAQTLVYDPAHRISAKRALQHPYFDTVNLSAA

SEQ ID NO: 4863 - protein, 509 aa, Chloroflexus aurantiacus
MGRFGCRVLSTVAAVRSIIRPNNVTVVWSKEKEATMTELRDFLEIPYEQLEELNLSVKRQRLARVSPDVMREERMRYLTDERRIKAVTVCFTDLEGRLHMLDYDKKFLLSSADNLTFDGSSVRGFSVQAESDLRLAIDWSAFYWLPADIFGPGKVLVFGFVLNQDGSPYEADMRGRLHRYVNELYQRDGLTCNVAAEIEGFLFKGRNAEQRFRETGEFTMVSTGGYYHSLPGDPLRQFIDMAAEAQRAMGFENEKDHPEVAPSQFEMNYSYTEATIAADQILLYKLICRQVASKLDMTACFLPKPVTGVNGNGMHTNISLSRHGENLFYDANGPERLSELAWSFIDRILNSGQELCLILNSSVNAYRRLDPHFEAPNQIKASPTDRGSMIRIPIGNARSARIEVRSIAPDANPYMAIYALLRTGLEGPLPTTDVRNGTATLPDNIYDAITNFRQSTFLASILGEGVHSRFADLKTTVADRCPRKLGTLIKRAEVQFHHEVTNQYLWSRF

SEQ ID NO: 4864 - protein, 504 aa, Sphingomonas sp. LB126
MMESTGNAAIFEQARARIARPFGHFINGLWEAGSGEPIAVVNPATEQPIGSIAAGGEAEVDRAVAAARQRFESAEWTRMPAAERERLLLRLADLVERDRDELAAIETLDNGMPFAPARMMAVGSAISAIRYNAGWARRMTGEEAPVSVPGRWHGYTSREPLGVAALIVPWNAPFAITCNKVSAALAAGCTVVLKPAELAPMSGLRLAELVQEAGFPDGCLNVVTGLGAQAGAALVRHPGVDKISFTGSTATGQSILRETAGRLTRVSLELGGKSAVLVFPDADLEKAIPAVAMGIFGNSGQVCAAGSRLFLHDSVFDRFVTGLVDFAEKLMVGPGDQPGVALGPLISAGQKERVMGYIAAGEAEGAQIATRGSAPDEPGYFVKPTIFVDTRPDMRIVREEIFGPVLSVMRFSDDNLENLARQANDSIYGLSAYVWTRDLSTAHAMARYLRAGSVKVNGSGMEFALPFGGFKQSGIGRENGPRGGGSLYRKEVGNDRLVMVWTAL

SEQ ID NO: 4865 - protein, 456 aa, Zea mays
  unsure (1)..(456): unsure at all Xaa locations
MTSPIQLAAAPLLLLVVVAGTRSSRIFSVADYGAAGDGFRYDTAAIQAAVDACAAAGGGRVLLPAPGNYLTATVQLRSRVVLEVPPGARLLGGTRQADYPPESRRWYVVLAENTTGAGITGGGEINGQGGAFVVRPSEVKNVMVSXXATGDCLGDECRPRLVGFIDSKDVRIHDITLNQPAYWCLHLVRCDNTVIHNVSIFGDFKTPNNDGIDIEDSNNTVITDCHIDTGDDAISPKSTTGPVYNLTATNCWMRTKSCAIKFGSASFFDFKRLVFDNITIVDSHRGLGMQIRDGGNVNDVVFSNIKMRTRYYHPLWWGRAEPIYITTCPRHPDSKEGAISDIRFINISSVSENGVFLAGSKHGLLRNLKFKNIDLTYKRWTNYTGGLYDYRPGCQEMVKHKTGGMMLEHISGLEIDNVRMRWARGSLKGWNVNPILFRPSTIDNLSFHDWQSVDVQ

SEQ ID NO: 4866 - protein, 489 aa, Geobacillus stearothermophilus
MKIKAQVGMVMNLDKCIGCHTCSVTCKNTWTNRPGAEYMYFNNVETKPGIGYPKQWENQEKYRGGWELKNGELRLKSGSKAMRLVNLFYNPYQPTIDDYYEPWNYDYETLTNSPLKQYQPVARPKSSITGEWMELSWGPNWEDDLAGVHITGLRDPNVVKMEQAIQTEFENVFMMYLPRICEHCLNPSCVSSCPSGAMYKRDEDGIVLVDQNACRAWRYCVTSCPYKKVYFNWQTNKAEKCTLCFPRIEAGMPTICSETCVGRIRYIGVMLYDADKVKEAASVTDEKQLYHAQLDIFLDPNDPAVAAAAKEAGIPDEWIAAAQRSPIYKMIVDWKIALPLHPEYRTLPMVWYIPPLSPIMNTIEGKGSQASADDIFPAIDEMRIPIEYLANLLTAGDTAHIRTTLKKMAAMRSYMRAKQTNKQPDTRLIESLGLSREDIEEMYRLLAIAKYEDRFVIPASHHEEVADLYAEQGSCGLAFAGGPGACGTL

SEQ ID NO: 4867 - protein, 378 aa, Zea mays
  unsure (1)..(378): unsure at all Xaa locations
MTWSVPPAAAGEASVDWPEPAPAPSSPRVRGRVGGRVGPLVMGKIKIGINGFGRIGRLMARVSLQSEDVELVFXNDPFITTDYMTYMFKYYTVHGHWKHSDITLKDSKTLFFYDKPVTVFGIXNPEEILWGEAGAEYVVXXTCVFTDKDKAVAHXKGVAKKVVIFVLIKDSPMFVVXVNEXKYXSDVKIVSNASCTTNXLAPLAKVIHNNFGIIEGLITTVNAITAXXKTVDGPSAKXWRGGRAASFXIIPRSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 4868 - protein, 205 aa, Listeria monocytogenes
IGGILVWFGWYGFNVGSALTIDNVAMTAFVNTNTAAAAGIIGWGLVEWLTNKKPTMLGTISGAIAGLVSITPAAGFVTVPSSLIIGFFGGALCFWAVFWLKGKVKYDDALDAFGLHGIGGIWGGIATGLFATTKVNEAGADGLFYGNASLVVKQLIAIGSTVAYVAVVTALIVVIIKLFLPIRVNEEQEYKGLDLTLHGEKAYQE

SEQ ID NO: 4869 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 4870 - protein, 443 aa, Escherichia coli O157:H7 EDL933
MQPSRNFDDLKFSSIHRRILLWGSGGPFLDGYILVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 4871 - protein, 356 aa, Emericella nidulans
MGSCFSSESAGDVEQKKRSQAIDRKLEEDSRRLRRECKILLLGSGESGKSTIVKQMKIIHQNGYTVEELALYRLTVYKNLLECAKALIGAYHQFNLEPTSQKVRDNIEFLANYNIDPDPNIPLDPAVGDAITYIWNDPCTSTALERQNEFYLMDSAPYFFEEAKRITSPDYIPNVNDVLRARTKTTGIYETRFTMGQLSIHMFDVGGQRSERKKWIHCFENVTSIIFCVALSEYDQVLLEEGNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 4872 - protein, 490 aa, Oryza sativa
AAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 4873 - protein, 449 aa, Bacillus firmus
MSNEREMQNKKDQQLESFRVEDEGKKLTTNQGLKVSEDEFSLKAGERGPTLMEDFHFREKMTHFDHERIPERIVHARGFAAHGEFQVYDSMKEFTKAKFLQDPSVKTPVFVRFSTVAGSKGSAETVRDARGFATKFYTEEGNYDLVGNNIPVFFIQDAIKFPDLVHALKPEPHNEIPQAQSAHDTFWDFIANNQESAHMVMWAMSDRSIPRSFRMMEGFGVHTFRFVNEEGKAHFVKFHWKPVLGIHSLVWDEAQKIAGKDPDFHRRDLWESIENGDYPEYELGVQLISEEDEFNFDFDVLDPTKIWPEEEVPVKIIGKMTLNRNVDNVFAETEQVAFHPGHVVPGIDFTNDPLLQGRLFSYTDTQLIRLGGPNFHELPINRPVCPFHNNQRDGYGRQTINKGQVSYHKNSLAANTPQPASEEEGGYAHYQEKVEGRKVRKRSESFKDP

SEQ ID NO: 4874 - protein, 132 aa, Pseudomonas aeruginosa PAO1
MSKIDKPLDSWREELTEEQFHICRLGGTERAFSGEYHATKTPGIYHCTCCGTALFDSDAKYDSGSGWPSYFQPVDAEAVRELDDFSHGMHRIEVRCGRCDAHLGHVFPDGPRPTGLRYCINSASLKLVPRES

SEQ ID NO: 4875 - protein, 711 aa, Geobacillus stearothermophilus
MRRWLSLVLSMSFVFSAIFIVSDTQKVTVEAAGNLNKVNFTSDVVYQIVVDRFVDGNTSNNPSGALFSSGCTNLRKYCGGDWQGIINKINDGYLTDMGVTAIWISQPVENVFSVMNDASGSASYHGYWARDFKKPNPFFGTLSDFQRLVDAAHAKGIKVIIDFAPNHTSPASETNPSYMENGRLYDNGTLLGGYTNDANMYFHHNGGTTFSSLEDGIYRNLFDLADLNHQNPVIDRYLKDAVKMWIDMGIDGIRMDAVKHMPFGWQKSLMDEIDNYRPVFTFGEWFLSENEVDANNHYFANESGMSLLDFRFGQKLRQVLRNNSDNWYGFNQMIQDTASAYDEVLDQVTFIDNHDMDRFMIDGGDPRKVDMALAVLLTSRGVPNIYYGTEQYMTGNGDPNNRKMMSSFNKNTRAYQVIQKLSSLRRNNPALAYGDTEQRWINGDVYVYERQFGKDVVLVRVNRSSSSNYSITGLFTALPAGTYTDQLGGLLDGNTIQVGSNGSVNAFDLGPGEVGVWAYSATESTPIIGHVGPMMGQVGHQVTIDGEGFGTNTGTVKFGTTAANVVSWSNNQIVVAVPNVSPGKYNITVQSSSGQTSAAYDNFEVLTNDQVSVRFVVNNATTNLGQNIYIVGNVYELGNWDTSKAIGPMFNQVVYSYPTWYIDVSVPEGKTIEFKFIKKDSQGNVTWESGSNHVYTTPTNTTGKIIVDWQN

SEQ ID NO: 4876 - protein, 453 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNSNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQPLIMNDQQQPVMSEQQQQQQQQQQQQ

SEQ ID NO: 4877 - protein, 375 aa, Zea mays
MQPQHNRLAFPSPPAPVSLSLSLSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 4878 - protein, 580 aa, Novosphingobium aromaticivorans
MAIREQRRSHADPCASHPLFGPATRRTRGRREADDRGARACRRLCGRRARTRAAPAADPGESSRGRGQGPGGIPIAVRATRTGGKPRTMADRTLAQRRDRMGLRPYCRHAARGPSLSAALRLARRASRRDLPRPLCPGVGAGPRGLRSAAAARGRVWCRPRASAGRALARSGRPARKAGQGNRKPPACRSSRRCYGGPRDSAGSAEAHRRRLTSRRKKTPEKTDEGVSMKIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 4879 - protein, 89 aa, Triticum aestivum
TGDRKGSHINLKVTGQDGNEVFFLIKRSTHLMKLMNAYCDRQSVDLNSIAFLFDGRMLRGEQTPDELAMEEGDNMDAMLHQTGWCFPGP

SEQ ID NO: 4880 - protein, 473 aa, Zymomonas mobilis
MSSESSQGLVTRLALIAAIGGLLFGYDSAVIAAIGTPVDIHFIAPRHLSATAAASLSGMVVVAVLVGCVTGSLLSGWIGIRFGRRGGLLMSSICFVAAGFGAALTEKLFGTGGSALQIFCFFRFLAGLGIGVVSTLTPTYIAEIRPPDKRGQMVSGQQMAIVTGALTGYIFTWLLAHFGSIDWVNASGWCWSPASEGLIGIAFLLLLLTAPDTPHWLVMKGRHSEASKILARLEPQADPNLTIQKIKAGFDKAMDKSSAGLFAFGITVVFAGVSVAAFQQLVGINAVLYYAPQMFQNLGFGADTALLQTISIGVVNFIFTMIASRVVDRFGRKPLLIWGALGMAAMMAVLGCCFWFKVGGVLPLASVLLYIAVFGMSWGPVCWVVLSEMFPSSIKGAAMPIAVTGQWLANILVNFLFKVADGSPALNQTFNHGFSYLVFAALSILGGLIVARFVPETKGRSLDEIEEMWRSQK

SEQ ID NO: 4881 - protein, 370 aa, Arabidopsis thaliana
MATLVDPPNGIRNEGKHYFSMWQTLFEIDTKYMPIKPIGRGAYGVVCSSVNSDTNEKVAIKKIHNVYENRIDALRTLRELKLLRHLRHENVIALKDVMMPIHKMSFKDVYLVYELMDTDLHQIIKSSQVLSNDHCQYFLFQLLRGLKYIHSANILHRDLKPGNLLVNANCDLKICDFGLARASNTKGQFMTEYVVTRWYRAPELLLCCDNYGTSIDVWSVGCIFAELLGRKPIFQGTECLNQLKLIVNILGSQREEDLEFIDNPKAKRYIRSLPYSPGMSLSRLYPGAHVLAIDLLQKMLVFDPSKRISVSEALQHPYMAPLYDPNANPPAQVPIDLDVDEDLREEMIREMMWNEMLHYHPQASTLNTEL

SEQ ID NO: 4882 - protein, 370 aa, Kluyveromyces lactis
MTGISQALALNDSGVNGFDTDLAKRNGTVNASGGQSPGGSETVNALKVLLLGSGESGKSTVLQQLKILHQNGFSREELLEYKPFIFDNIIETGKDLAKARRTFNVQLEEDAEISESDLDELLSQQYQPTKLPCLPADLAKTLKILWNLQSTQDLLVSEHRSSFYLMDSASYFYENLDRISEPKYIPTITDVIRTRKKTSGIFDTMIDLDKNLKLHFFDVGGQRSERKKWIHCFDNVTLIIFCVSLSEYDQTLLEDNSQNRLEESLILFDSVVNSRWFARSSVVLFLNKIDIFAEKLRHVPLEKYFPDYTGGKDINKAAKYILWRFVQLNRANLNIYPHVTQATDTSNIKLVFAAIKETILENSLKDSGVL

SEQ ID NO: 4883 - protein, 498 aa, Rhizobium leguminosarum
MREIGHFIGGKQVAGTSGRVSNVYNPATGEVQATVALASVEELRAAVENAKAAQPKWAATNPQRRARVFFKFVELLNKHMDELAEILSKEHGKTIEDAKGDVIRGLEVCEFVCGIPHLAKGEFTEGAGPAIDMYSIRQPVGIGAGITPFNFPGMIPMWMFAPAIACGNAFILKPSERDPSLPIRLAELMIEAGLPAGILNVVNGDKGAVDAILTDPDIGAVSFVGSTPIARYVYGTAAMNGKRAQCFGGAKNHMIIMPDADLDQAVNALMGAGYGSAGERCMAISVAVPVGEETANRLVEKLTPKIESLRIGPYTDDKADMGPLVTKEAYTRVRGLIDRGIEEGAKLVVDGRDFKLQGYEDGYFVGGCLFDHVTPDMDIYKTEIFGPVLSVVRAQNYEEALSLPMKHEYGNGVAIFTRDGDAARDFASRINIGMIGINVPIPVPLAYHSFGGWKASSFGDLNQHGTDSIKFWTKTKTVTARWPSGIKSGAEFVMPTMK

SEQ ID NO: 4884 - protein, 466 aa, Escherichia coli O157:H7 EDL933
  unsure (1)..(466): unsure at all Xaa locations
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 4885 - protein, 438 aa, Azotobacter vinelandii
MTLRKGAGLAALSSLFLPVMASAQEATLDSGDTAWMLTATALVLFMTIPGLALFYGGMVRSKNLLSVMMQCFAITGLISVLWVLFGYSLAFDTAGMEEGVLNFSSFVGGLDKAFLSGLTTDSLVGTFPESVFITFQMTFAIITPALITGAFAERMKFSSMLVFMSAWFLLVYAPIAHMVWSGNGALMWDWGVLDFAGGTVVHINAGVAGLVACLVLGKRKGYPGVAMTPHNLGYTLVGAAMLWVGWFGFNAGSAIAANGTAGMAMLVTQIATAAAALAWMAAEWLTHGKPSALGIASGVVAGLVAITPAAGTVGPMGALVIGLASGSICFYCATAVKRRFGYDDSLDAFGVHGVGGIVGAVLTGLFAAPALGGFGEIDSIASQLWIQIKGVLFTVIYTGVATFVILKAIERVIGLRISEEEETMGLDLSLHNERGYNL

SEQ ID NO: 4886 - protein, 405 aa, Mesembryanthemum crystallinum
MVLEATMICIDNSEWMRNGDYTANRFQAQADAVNLICGAKTQSNPENTVGILTMAGKGVRVLVTPTSDLGKILACMHGLDMGGEMNLAAGIQIAQLALKHRQNKKQQQRIIVFAGSPVKYDKKVLETIGRKLKKNSVALDVVDFGEDEDGKSEKLEALVAAVNNNDTSHIVHVPAGPNALSDVLISTPIFTGDGEGGSGFAAAAAAAAAGGVSGFDFGVDPNLDPELALALRVSMEEERARQEAAAKRAAEEAGRQEKGGEQQSSSQDATMGESSSAANPEAEKKNDLTDDENALLQQALAMSMDEPASTTTVRDTDMADATGDDQDLQLALQLSVQDSAKESTSQSNPEEVGKLLADQSFVSSILASLPGVDPNDPSVKDLLASMQNQSEKKDEDKPPSEEEKK

SEQ ID NO: 4887 - protein, 508 aa, Zea mays
  unsure (1)..(508): unsure at all Xaa locations
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVQAARSWKVGDPFDVTSNMGPQVDKDQFERVLKYIEHGKSEGATLLTXGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 4888 - protein, 373 aa, Glycine max
MWLVLAVANEGVAVAKRAAPKPVSKKVIVKPKPSEKVTDIDASPDKKRVLKDKKKEGDANPKKKSQHTLTSVLTARSKAACGITNKPKEQIIDIDASDVDNELAAVELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 4889 - protein, 109 aa, Zea mays
GDELWPADKLGFTKTAIQAKSDSVYFVVSRGAEVDERATHVCLDCGYIYFLPKPFDEQPDDYGCPQCNAPKKRFARYDAATGKAIGGALPPIAVIVSLVIGIAGVGALL

SEQ ID NO: 4890 - protein, 125 aa, Triticum aestivum
  unsure (1)..(125): unsure at all Xaa locations
VARAMFACCALDGKIIVAGGFTNCRKSISEAEIYDPEADTWESLPDLRQAHPSACSGLVIKDKMHVLHKGISTVQILEDGGNYWAVEDYSWLQGPMAMVGGXLYVLSNSCIRKQHGENFPDKWSL

SEQ ID NO: 4891 - protein, 93 aa, Glycine max
MSGLIEGLPDAVAIRCLAWVPFYLHPKLELVSRAWRAVVRGPELFKARQELGSSEDLVCVCAFEPKNLWQLYDPQRDLWITLPVLPSRIRHLS

SEQ ID NO: 4892 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQYEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 4893 - protein, 342 aa, Glycine max
MSVSCSNCFPDDDDSFLLCGEDSSGIIDSSPECSSDLDSPPPSEAEAESIAGFIEDERNFVPGFEYLNRFQSRSLDASAREESVAWILKVQAYYAFQPLTAYLSVNYLDRFLNSRQLPQTNGWPLQLLSVACLSLAAKMEEPLVPSLLDLQVEGAKYVFEPKTIRRMELLVLGVLDWRLRSVTPFSFLDFFACKLDSSGTFTGFLISRATQIILSNIQEASFLAYWPSCIAAASILHAANEIPNWSFVRPEHAESWCEGLRKEKVIGCYQLMQELVINNNRRKPPKVLAQLRVTTRTRMRSSTVSSFSSTSSSSSSTSFSLSCKRRKLNNRLWVDDEKGNSE

SEQ ID NO: 4894 - protein, 333 aa, Ralstonia eutropha
MTARASQDSAALPLDKETLLTVYRKMRTIRDFEERLHVDFGRGDIPGFVHLYAGEEAAGVGILHHLNDGDRIASTHRGHGHCIAKGVDPVAMMKEIYGKKGGSCNGKGGSMHIADLSKGMMGANGILGAGAPLICGAALAAKFRGKGEVGITFCGDGASNQGTFLESLNLAAVWNLPVIFVIENNGYAESTSRDYGTAVDSYVDRAAGFGIPGVTVDGTDFFAVHEAAGEVIRRAREGGGPSLLECKMVRFYGHFEGDAQTYRAAGELDDIRANKDCLKLFGRAVTQAGVVAREELDTIDREVAALIEHAVQEAKAAPQPGPEDLLTDVYVSY

SEQ ID NO: 4895 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 4896 - protein, 447 aa, Neurospora crassa
MLLDVKASQRLDSRGNPTIQVEVRTAHGIFRALVPSGASTGVHEAVELRDNDKRKYGGKGVLTAVNNVNEIIGPALVKEGYSSRRDLKQIDGFMRELDGTPNKAKLGANAILGVSMACARAGAAAANIPLYEFLRREGGEEAPYMVPVPFFNVLNGGRHSGNGMAFQEFMIAPTGAKTIEEGIQMASETYFVLKQMISDKFGAIYTGVGDEGGFAPPITQPEEALDLLTEAVAKAGYTDKIKFGIDAASSEFFNPENGTYDLGFKRIKEGESHSDDVRTPAEMMALYKSLIEKYPIPLLEDPFAEDDWESWTKFCKDFYFEELVGDDLLVTNVERVRMAESRVACNAMLLKINQIGTVTEALDAAKLAKSLGWGVFVSHRSGETTDDFIADLSVGLCTGHIKSGAPCRGERVAKYNRLLDIETELKESWKPWSYAGEKFRKPEAFFI

SEQ ID NO: 4897 - protein, 214 aa, Glycine max
APPPQPLLLITIQTKTTHSSHFFCCIPNGISLDYVQLFIALNKTNSSKMSTPLFHEFKRQASFFFKEKIKTARLALTDVTPAELMTEEATSGNPWAPDARTLRSISRDAFELDDYWRIVEILHKRFLKFEKKNWRVSYNSLIVLEHLLTHGPESVAEEFKSDKDVISQMKGFQYIDDTGFNWGLTVRKKSERITKLLEEGTLLKEERKNARRLS

SEQ ID NO: 4898 - protein, 423 aa, Batrachospermum helminthosum
  unsure (1)..(423): unsure at all Xaa locations
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTXT

SEQ ID NO: 4899 - protein, 491 aa, Bacteroides thetaiotaomicron VPI-5482
MANQNKTDIGLIGLAVMGENLALNMESKGWHVSVYNRTVPGVEEGVVDRFMNGRAKGKNIEGFTDIKAFVESIATPRKIMMMVRAGSPVDELMDQLFPLLSPGDILIDGGNSNYEDTNRRVKLAESKGFLFVGSGVSGGEEGALNGASIMPGGSEKAWPEVKPVLQSIAAKAPDGTPCCQWVGPAGSGHFVKMIHNGIEYGDMQLIAEAYWVMKNLIDLTNEEMADVFARWNEGKLRSYLIEITSNILRHKDKSGGYLIDKILDAAGQKGTGKWSVINAMELGMPLGLIATAVFERSLSAQKELRHLASKQFLCKHTLPIYNKAELVKEIFSALYASKLVSYAQGFAVLQRASDSFGWNLDLASIARMWRGGCIIRSIFLNDIAAAFEAADKPKHLLLAPYFREEIKSLLPGWKNLVAEAMKEELPVPAFSSALNYFYSLTSDNLPANLVQAQRDYFGAHTFERKDELRGQFFHENWTGHGGETKSGTYNV

SEQ ID NO: 4900 - protein, 514 aa, Arabidopsis thaliana
MAGGFVSQTPGVRNYNYKLTPKVFVTCFIGAFGGLIFGYDLGISGGVTSMEPFLEEFFPYVYKKMKSAHENEYCRFDSQLLTLFTSSLYVAALVSSLFASTITRVFGRKWSMFLGGFTFFIGSAFNGFAQNIAMLLIGRILLGFGVGFANQSVPVYLSEMAPPNLRGAFNNGFQVAIIFGIVVATIINYFTAQMKGNIGWRISLGLACVPAVMIMIGALILPDTPNSLIERGYTEEAKEMLQSIRGTNEVDEEFQDLIDASEESKQVKHPWKNIMLPRYRPQLIMTCFIPFFQQLTGINVITFYAPVLFQTLGFGSKASLLSAMVTGIIELLCTFVSVFTVDRFGRRILFLQGGIQMLVSQIAIGAMIGVKFGVAGTGNIGKSDANLIVALICIYVAGFAWSWGPLGWLVPSEISPLEIRSAAQAINVSVNMFFTFLVAQLFLTMLCHMKFGLFFFFAFFVVIMTIFIYLMLPETKNVPIEEMNRVWKAHWFWGKFIPDEAVNMGAAEMQQKSV

SEQ ID NO: 4901 - protein, 213 aa, Vibrio parahaemolyticus RIMD 2210633
MSDNNQCVIVGIAGASASGKSLIASTIYNELRAKVGDHQIGVITEDCYYNDQSHLSMEERVKTNYDHPSALDHDLLCEHLEKLVRGEAVEVPEYSYTEHTRTSNTTTMTPKKVIILEGILLLTDPRLRDLMHATVFMDTPLDICLLRRVKRDVEERGRTMESVLKQYQQTVRPMFMQFIEPSKQYADIIVPRGGKNRIAIDVLKAHIAKLLKA

SEQ ID NO: 4902 - protein, 299 aa, Staphylococcus kloosii
GFGRIGRLAFRRIQNVDGIDVVAVNDLTDDEMLAHLLKYDTMQGRFTGEVEVEENGFRVNGQEVKSFSEPDPSKLPWGDLDIDVVLECTGLFADKDKASAHIDAGAKKVLISAPATGDLKTIVYNTNHNELDGSESVVSGASCTTNSLAPVAKVLNDEFSLVEGLMTTIHAYTGDQSTQDAPHRKGDKRRARAAAENIIPNSTGAAKAIGLVIPEIDGKLDGGAQRVPVATGSLTELTVVLEKDVSVEDVNNAMKNASNESFGYTEDEIVSSDVIGMTYGSLFDATQTRVMTVGDSSIS

SEQ ID NO: 4903 - protein, 491 aa, Oryza sativa (japonica cultivar-group)
MDAAMESAVGPHFSGLRLDSRRLSSSSLPTSPSAASSNGCGGNDAPAAVNGFAPPPPPSAAAAAEEGSKQPFVIGVSGGTASGKTTVCDMIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPRGGDNHVAIDLIVQHIRTKLGQHDLCKIYPNVYVVNTTFQIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGNSANQAIELLISSGVPEERIMFLNLISAPEGVHCVCKRFPRLKIVTSEIETGLNEEYRVIPGLGEYGDRYFGTD

SEQ ID NO: 4904 - protein, 497 aa, Ustilago maydis
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 4905 - protein, 157 aa, Chlamydomonas reinhardtii
MALSNYVFGNSAADPFFTEMDRAVNRMINNALGVAPTSAGKAGHTHAPMDIIESPTAFELHADAPGMGPDDVKVELQEGVLMVTGERKLSHTTKEAGGKVWRSERTAYSFSRAFSLPENANPDGITAAMDKGVLVVTVPKREPPAKPEPKRIAVTGA

SEQ ID NO: 4906 - protein, 545 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSSVQV

SEQ ID NO: 4907 - protein, 361 aa, Saccharomyces cerevisiae
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 4908 - protein, 492 aa, Triticum aestivum
MDPYKYRPSSSFNAPMWSTNSGAPVWNNDNSLTVGSRGPILLEDYHLVEKIADFDRERIPERVVHARGATAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDIGVPADYRHMDGSGVNTYTLVNRAGKAHYVKFHWKPTCGVKSLLEEEAVTVGGTNHSHATKDLTDSIAAGNYPEWTFYIQTIDPDYEERFDFDPLDVTKTWPEDVVPLQPVGRLVLNRNIDNFFSENEQLAFCPGIIVPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 4909 - protein, 178 aa, Zea mays; identical to SEQ ID NO: 3538

SEQ ID NO: 4910 - protein, 130 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 4911 - protein, 402 aa, Zea mays
TRPPTRPPTRPVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSHDGEFPQQEIIGVFNKNCMISYSQYRNIFPIWALGEYRCRVLGAGKSWR

SEQ ID NO: 4912 - protein, 217 aa, Mangifera indica
MAGFRAEDDYDYLFKVGLIGDSGVGKSNLALRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGNLLAERESLSFMETSALEATNVDNAFAEVLSKSTALLARRLWKLVIIDQDAVPSKSEKIDVSKDVSAVKKVGCCSG

SEQ ID NO: 4913 - protein, 289 aa, Oryza sativa
LLLASVALLLLVALGALSLPSGGDPPRVADVRACVRVCRGLEMRGGEKGEPWTEVLSWEPRAFLYHNFLECQSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGGCPIQRLLTNSNLSMLLLKERKEKRSFLAHVEDFNFSIEKHYNFF

SEQ ID NO: 4914 - protein, 495 aa, Triticum aestivum
MASKGERDVEIHVSSPPPDDRDAARPLLPAACEAYSVSAAILPFFFPALGGLLYGYDIGATSGATISLKSPTSSGTAWHDLSSVQTGLVVSGSLYGALIGSATAFTIADFLGRRRELVVSSIMYLIGALLTAVAPNFLIMVVGRFLYGIGIGLAMHAAPMYIAETAPSQIRGMLISLKEFFIVLGMLLGYIVGNLFVEVISGWRYMYATSAPICVIMGIGMCWLPCSPRWLLLCATQGKGDLRETKECAPPCSCRLRGPASPDLVSERVTLLLEEPAHVGEEFQPGFGGCFQGRGLLAIVIGCGLVFFQQVTGQPSVLYYAATIFQSAGFSGASDATRVSILLGVLKLIMTGVAVLVVDKLGRRPLLIGGVSGIAVSLFLLSSYYTLFTGAPYVAVIALLLYVGCYQLSFGPIGWLMISEVFPLKLRGRGLSVAVLVNFASNALVTFAFSPLEDLIGTGVLFASFGVIAVASLTFIFCIVPETKGLTLEEIEAKL

SEQ ID NO: 4915 - protein, 600 aa, Glycine max
MWKVVRFAAARSRRFSTAIPGPCKVHKRGTDILHDPWFNKDTGFPLTERDRLGLRGLLPPRVISFEHQYDRFMNSHSALEKNTQGQSDRFVSLSKWRILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDRLYLGLRQPRLEGEEYLSIVDEFMEAVHARWPKAIVQFEDFQMKWAFETLKRYQKKFCMFNDDIQGTAGVALAGLLGTVRAQGRPLTDFVKQKIVVVGAGSAGLGVLSMAVQAVARMSGCSELAAKSQFYLIDKDGLVTTERNSLDPAAAPFAKNPRDLEGLSEGASIIEVVKKVKPHVLLGLSGVGGVFNAEVLKAMRESVSTKPAIFAMSNPTMNAECTAIEAFSHAGENIVFASGSPFENVDLGNGEVGHVNQANNMYLFPGIGLGTLLSGARHITDGMLRAAAECLASYMTEDDVRKGILYPSIDCIRDVTAEVGAAVVCAAVAEKQAEGHGDVGFKELENMSKEETVEYVRGNMWYPEYCPLVHEK

SEQ ID NO: 4916 - protein, 234 aa, Nitrosomonas europaea ATCC 19718
MKIILIKAYELESELERRGKTEMLQYVRNLLPDDMKCVYIRQSEALGLGHAVLCAQPAVGDEPFAVLLADDLLEGDPVVIRQMVDVYEYYKCSVLGVQQVPREDTRSYGIVASQPIRDDLEAVQFIVEKPDPEEAPSTMAVVGRYVLTPRIFHHLIRLGKGTGSEIQLTDGIAALMQEEQVLAYRYKGQRYDCGSKIGYLEATLAMARKHPEVGAQFEQLLQSFQHQGNSEERQ

SEQ ID NO: 4917 - protein, 309 aa, Arabidopsis thaliana
LPSVSFQLPVIDFSDQNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRIAQSA

SEQ ID NO: 4918 - protein, 542 aa, Escherichia coli
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 4919 - protein, 289 aa, Neisseria meningitidis MC58
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAPKGALKQMVEVYGRSGNSILGVETVEASQTGSYGIVETEQLKQFQRITGIVEKPKPEDAPSNLAVVGRYILTPRIFDLLTNLPRGAGNEIQLTDGIAKLLDHEFVLAHPFEGTRYDCGSKLGYLEATVAYGLKHPETGEPFRRLLEKYRTE

SEQ ID NO: 4920 - protein, 505 aa, Citrus x paradisi
MDLLLLEKTLLALFAAVVVAITVSKLRGKRFKLPPGPLPVPVFGNWLQVGDDLNHRNLSDLAKKYGDVLLLRMGQRNLVVVSSPDHAKEVLHTQGVEFGSRTRNVVFDIFTGKGQDMVFTVYGEHWRKMRRIMTVPFFTNKVVQQQRFNWEDEAARVVEDVKKDPEAATNGIVLRRRLQLMMYNNMYRIMFDRRFESQDDPLFNRLKALNGERSRLAQSFEYNYGDFIPILRPFLRGYLKICKEVKERRLQLFKDYFVEERKKLASTKSMSNESLKCAIDHILDAQTKGEINEDNVLYIVENINVAAIETTLWSIEWGIAELVNHPEIQKKLRNELDTVLGPGHQITEPDTHKLPYLQAVIKETLRLRMAIPLLVPHMNLHDAKLGGYDVPAESKILVNAWWLANNPAQWKKPEEFRPERFLEEESKVEANGNDFRYLPFGVGRRSCPGIILALPILGITIGRLVQNFELLPPPGQSKIDTAEKGGQFSLHILKHSTIVAKPRSF

SEQ ID NO: 4921 - protein, 214 aa, Corynebacterium efficiens YS-314
MSAEHVTETALLKFERGTMTNDPLGNLTDVLENREPLPNVEPDPEYLMATEQESNPSSFRRALVVLITDHPDAVAQEKGCLVTELLVETGFAVDAVVQVPSKKSQIRQAIETAVVGGADLVLTVGGVGVGPRDRAPEATRSILDQSVPGIAQALRSSALASGAVDASVSRGVSGISGSTLVVNLADSDEAIREGMTTVGPLVHHVVDQMQASVV

SEQ ID NO: 4922 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 4923 - protein, 631 aa, Zea mays
MFSWSRKQSSSGSSSGRRRGGADASMDSSSRGGSGSRGRSPRLDRRNAVKRIEYEASAGASASWSSSSSAEQQRSPGLRPSRSLDLAPGADLRISGSVEGEVDELCRSLGLSGPEDFAVPVAAWEARKSRSNSDLLPRSRLDPSTPADETSPIARAVSAPGAQPTRSFPAPIPEESLHSSPASTATESAEEPTVAAPEESPNAAPASAVVAPVGGLPLPSPRRGGGEVGIRGARPPLLSPPPPIGALAPPPVRRSFVDNDMTGSAWDIVQSFAPRDQGSELGLGGSVDSRCNSDKEEENDVEDGDAAVEGELKELRIGETFEGFTGTSSLSTTNDDDASSTTTEAMFIISPNGKFKRNIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNIEWTNAFFMIGRGEQPTIPCYLSKEAQDFIGQCVRVDPESRPSASQLLEHPFVNRPLRASFESSSPPAI

SEQ ID NO: 4924 - protein, 723 aa, Xanthomonas axonopodis pv. citri str. 306
MAADRIETLIARMTVEEKVGQLGVFADMVRPFAPDVNPEANVLNADEVLQQVRLGRVGSLFNGVGAALGVQIQKVAVEESRLGIPVILAADVIHGMRTVFPIPLGEAASFEPALAERTARATAIEATAAGLHWTYAPAVDIARDQRWGRGAEGAGEDVMLGAAFAAARVRGFQGSDLTAHDCLLATPKHFAAYGAVAAGMEYNTVDIAPQTLRDVHLPPFKAAFDAGALTVMSSFNDINGVPASANHELLTEILRGEWQFPGVVISDYTADMELIAHGYAADERDATKKAFLAGLDLSMQSGFYAAHLPSLVESGEVPMATLDASVRRILQLKEAIGLFDNPYRSLDPAREADTTHLPAHDALSRDAARRSIVLLKNEGGVLPLKKSGQRIALIGPFVQDRENIEGCWTLFGDKERYVTLEQGVRAVVGTEDLSVVAGCGLEEALPGGISAAIDAAQAADVVVLALGEPQRFSGEAQSRTEITLPPAQQALAEAIAATGTPMVVLLRNGRALALGGAVRDADAIAVTWYLGTQTGTGVADVLFGDYNPSARLPISFPQATGQQPYFYNHLRTGRPELPTLSEYKARWREMPNEPLYPFGHGLSYTTFAYAQPQLSAAQLGWDEALTITTRVSNTGKVAGEEVVQLYVHDRVASRVRPVRELKGFRKVLLQPGESQDVVFTLERDALAFTNHKGVFGAEPGLFDVWVCASAKSGEAVTFELLER

SEQ ID NO: 4925 - protein, 347 aa, Streptococcus agalactiae 2603V/R
MFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 4926 - protein, 926 aa, GIBBERELLA ZEAE PH-1
MKTILFSAALIPFLTVSSLAADDDNVTCRTELGKTSVASIKTDTVTKTDPIKPTKTVTIIPTETEKVGLWSTVTKFSRKTFTRTAKGGTDTFSTTSTLFKIATVTVTATNTITTTKTGTVMSTRTTVVPTTAGFRFISDTVNEESFAPVAGPRKFARNPHAPPLVKPGLKAFAFPNKVHCTELLPNTDTRTVKKTGSPTTTTVSTMRTKTKIAIISTTTTLIPDDVSVTKTFTTNMKVTTYSTTYKTSTKSATATKTSIKSGPTEYAACSEGNMFGPNFNSGGTGYYITNVLNNGPGIPSDYKIVSSGADSADDCCSSCMKFNGCETWIYRERNRNCFLLYHVLEKGEKCPSQKNHPNFFLSKKGADTGAGFIAGNAYDISYSEAIPFDHRLRMPSFQAMGYDLRAIDQSLIQPPSETTGIQYIEVNDDTNYHDIHWLLNPPFTMANFETKLFINNEYVDAKSDKRISVHNPIDGSLVSSDVHVAGPQDVDDAVEAAQAAYAGPWKRFTAAQRSECLVKFADLVDSKEKELAELETIAMGQPTSIAVRITSMMSSLFRYYAGWTDKIHGEQLPPEGGVYKIISHHPYGVVAGISAWNGSAIQLGLKVAPAVAAGNTIVYKMSEKSPLGMLQLGYLVKEAGFPPGVINILNGAGETGSLLASHMKIRMISFTGSGFTGRKISEAAAKSNLKKVALELGGKSPVLVFNDANTEKAIDFCTNMFLFNSGQVCAAPSRVYVQRDIATSFIETLKTRYTQAATGLGGDPKDPSTFMGPLADGAQYERVMGFIDSGNKEAELAVGGHRVGDQGYFVAPTIFVNPKSDARILKEEIFGPVLTVVTFDTEEEALKLANDTEYGLAAYVWTESLSRGLRMSDQLEAGVVGINGGSLGAIPMMSVGGFKQSGTGSESGYEGIREYLQSKATLIAMN

SEQ ID NO: 4927 - protein, 136 aa, Pisum sativum
NTDITSNGERVKCMQVWPPIGKKKFETLSYLPPLTRDQLLKEVEYLLRKGWVPCLEFELLKGFVYGEHNKSPRYYDGRYWTMWKLPMFGTTDPAQVVKEVDEVVAAYPEAFVRVIGFNNVRQVQCISFIAHTPESY

SEQ ID NO: 4928 - protein, 477 aa, Ahnfeltiopsis sp. FredericqS_6.ix.93
KNERYGIWCNSYAKMGYWDPDYVVKDTDVLALFRVSPQPGVDPIEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRAIAGAGEVKGHYLNVTAATMEEMYERAEFAKQLGSIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 4929 - protein, 345 aa, Arabidopsis thaliana
MASSTGEKGLIVSFGEMLIDFVPTVSGVSLSESPGFLKAPGGAPANVAIAVSRLGGRAAFVGKLGDDDFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTENKTMDDKTAMSLWHPNLKLLLVTLGEKGCTYFTKKFHGSVETFHVDAVDTTGAGDSFVGALLQQIVDDQSVLEDEARLRKVLRFANACGAITTTKKGAIPALPTDIEALSFLKDQKKRQTNLKFSKWCCTASPC

SEQ ID NO: 4930 - protein, 198 aa, Zea mays
MAEGKRWRFAMVCSSNMNRSMEAHSQLGRAGLDVESYGTGTHVKLPGPSLHEPNVYDFGTPYGAIYDDLRRKDPELYKRNGLLPMLKRNTSVKLAPQRWQDNAGDGVFDMIMTFEERVFDLVVEDMNNREPRLMKCVLIINMDVKDNHEEAGVGAKLAVELCQKLEAIDGDWEDIIDDLITAFEKQHKRRLAYSISFY

SEQ ID NO: 4931 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEEGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 4932 - protein, 560 aa, GIBBERELLA ZEAE PH-1
MDDDPKAALGQGLKSDNISTDSEIILTPEPASPDNAPVDSTLLDTPVLGATTPRGSMHSRHPSFSGSSSNHEDWDGPPLDRLSVLDLLENFALPQQLEKLQKGITAQTDKVRRSREAIKTKTQSARHRMVEEWRRRVPEADEQLDRYRKQMQHRVDKLGKRWGDTKVISAREKVSFIFGVMNIFLSGYLIGAHPEQFHWWYTVQLLYFMPIRFFTYRQRGYHYFVADLCYFTNLLLALSIWVFPGSKRLFTASYCLAFGNNAVAIIMWRNSLVFHSFDKVTSLFIHIMPCATLHCIVHLFSPEKQKEQFPAIWTIKNSPPGSPTAYANVVSMLAWSTLPYIFWQLMYYFFITVRRRDKIAAGRPTSFTWLKKSYANTWLGKFVLRQPERLQEATFMLIQYSYALLTMLPCPLWFLSRWASATFLMVVFTWSIYNGATYYIDVFGVRFQKELEAMKAEVAQWQNSPEHLPQSPTLEARPDESSANQLTQQGVAPSASTGQIPSMNEVNREKNMMGGTSLSKDDANRPISVDNIPLLNDMQSSSSTGVDGRPVNNTRGRRVD

SEQ ID NO: 4933 - protein, 357 aa, Prochlorococcus marinus subsp. pastoris str. CCMP1378
MKRYKVVLLSGDGIGPEISEISITILKKLSKKYGFNLDIKEEYFGGIAYEKHNDPAPKETLDQCKASDAVLLACVGDVKYDTLPRELRPESGLLKLREALNLFANIRPVKIRKSLLDSSSFKKEVIENVDLIVVRELIGGIYFGQPRGEITQTKIKKAFNTMVYDSNEIERITEVAIKIANQRSKKICSVDKSNVLEVSQLWRDTVSLVASKENDLALSNMYVDNAAMQLVKDPGQFDVILTSNLFGDILSDLAAMITGSIGMLPSASLSNSGPGVFEPVHGSAPDIAGKNIANPIAMALSTSMMLKIGLNEIEAADDIEIAIDNVLSKGYRTSDLDNGNCQVLSCSEIGEKIIQEI

SEQ ID NO: 4934 - protein, 298 aa, Oryza sativa
  unsure (1)..(298): unsure at all Xaa locations
MEREELLEQRATATGPSRDGSATAGRQRRRIAHXAAGDALRVGAMRGGGGGLNFFXSRSHAARLVDLITSPWPTRVVTSKHTAPSSHAPRXVRHECSIMGEIRALHNMDDDEVFAYANRIAAPYDLVMQTKQLGRLPVVQFATGNVATPADAALMMQPGCDGVFVSSGIFKSGDPARRAHAIVQAVTHCRSSRPSTPPPRRPRWHTFAVELCPVVLFVALCNLWVIRNDVHHIDVPESPNVVMERIAFWLEEWANLNSGKSPAVHYPAKWWQTPSSGWFKVNIDGAFMASELKGSGSC

SEQ ID NO: 4935 - protein, 164 aa, Zea mays
AKVLCTSPCFYVTIYINITNKVLLDQFFDHAIGINVPRSRFLPVKATSDLQLVQSDLYTLVDGFVTRNSARTNPSNPSIELGPEFKKVGSFLGRFKSIPSIVELDILKVSGDVWFGSGIVLKGKVTITAKPGVKLEIPDGAVIGNKDNFGKGKRKQYQMPYNLN

SEQ ID NO: 4936 - protein, 297 aa, Agrobacterium tumefaciens str. C58 (U. Washington)
MALPHIFLALITVFLWGFNFVAIKVGVADMPPLFLTGVRYLFAAVPLVFFLPKPNVPWRHMIVYGMAMGFFQFGLLYPAIKLGLPAGLASLVMQSQAFFTLALAVVFLGERPLPSQIAGAIVAFGGLAVIGMERMTAAALIPLLMGVGSAIAWACGNIVNRRIGQVNVVSFIAWTSLVPVLPLVLLSLVVEGPDAIVEGLQNATPTMALVVIYMAYGATIVGAGIWSYLLLRYPAGTVAPFSLLVPIVGFISAYLAFAEHITIFEIIGAALVILGLALNVFGRRIGVSRFWVRSPQG

SEQ ID NO: 4937 - protein, 258 aa, Saccharomyces cerevisiae
MGSRSENVGTVTREGSRVEQDDVLMDDDSDSSEYVDMWIDLFLGRKGHEYFCDVDPEYITDRFNLMNLQKTVSKFSYVVQYIVDDLDDSILENMTHARLEQLESDSRKLYGLIHARYIITIKGLQKMYAKYKEADFGRCPRVYCNLQQLLPVGLHDIPGIDCVKLYCPSCEDLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 4938 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 4939 - protein, 299 aa, Escherichia coli O157:H7
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAISGVLVLIEDSFNGQHVAMLGFMLTLAAAFSWASGNIFNKKIMSHSSRPAVMSLVVWSALIPIIPFFVASLILDGSGKMIHSLVTIDMTTILALMYLAFVATIVGYGIWGTLLGRYETWRVAPLSLLVPVVGLASAALLLDERLTGLQFLGAVLIMAGLYINVFGLQWRKAVKVRG

SEQ ID NO: 4940 - protein, 282 aa, Microbulbifer degradans 2-40
MATYIPELANVDPNKLGMHLTTVTNQHFAYGDAEEAFSIQSIAKVWSLTLALKHLGADTWQRVGVEPSGTAFNSLVQLEYEMGIPRNPFINAGAIVVCDILVSCLKNPKEDLLDFIRTSSGIPSIEYCPVIAESEVKTGHRNYALAHMMKGFGNIHNDVDCVLDLYFSLCSIKLTCKQLAQAFLFLAAGGVNPATQQQVITPKRTKRINSIMQMCGFYDEAGEFAFKVGLPGKSGVGGGIVAVHPGKYCIAVFSPRLNASGNSVKAMKVLEALTTKTELSIF

SEQ ID NO: 4941 - protein, 525 aa, Triticum aestivum
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVEPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDSIAPTGV

SEQ ID NO: 4942 - protein, 497 aa, Oryza sativa
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVADGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 4943 - protein, 308 aa, Vigna radiata
PVVDMKNLNNEERGATMEKIKDACENWGFFEVVNHGISIELMDSVDRLTKEHYKRCMEERFKEMVASKGLECAESEINDLDWESTFFLRHLPVSNISEIPDLADDYRKVMKDFAVELEKLAELVLELVCENLGLEKGYLKKAFYGSKGPNFGTKVSNYPPCPKPELIKGLRAHTDAGGIILLFQDHKVSGLQLFKDGHWIDVPPMRHSIVVNLGDQLEVITNGKYKSVMHRVITQTDGNRMSIASFYNPGNDAVIAPAEALVKEDESSKVYPKFVFDDYMKLYAGLKFQAKEPRFEAMKAIDGPIATV

SEQ ID NO: 4944 - protein, 380 aa, Lagenaria siceraria
MKKMALHSNKHRTQRLHNSLFFFDFLHCTEQQHLQTEHPIFLNNGGTNDFPLFQQTTTHFLVYEDEELNHLLSKEKDQNLQTGAVLKTLVQTDNALSLARTEAIDWLLKVNAFYGFSSLTALLAINYLDRILSGPYFQRDKPWMLQLAAVTCISLAAKVEEIRVPLLLDLQVEDSKYIFEAKTIQRMELLVLTALQWKMHPVAPVSFLGIITKGLGMKNQYIQREFLRRCERILLSLVSDSRSVGILPSIMAVSAMVSVVEEMGNCNPLEEFQDQLLNALKINKGRVKECCKVIMEAKIKGSGKRKHVEEEAEAEAESESSEAETEGEAEAEAGSPNGVMEANFSCESSNDSWEMGTIVSEYTHFSSSSSSSSKRIRPTR

SEQ ID NO: 4945 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 4946 - protein, 642 aa, Oryza sativa
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRWDPRPHLSSSSLTSRRPNRRHGRQILPRHRLSRACVDAVVAHVGAVFPHSPRENRRRLLRASPHPGILSVSPFNRRNHPSTVHPKPPPPYAARPPFRLRPEERRRRAPPPFPAPRCRVLGELLLSLLASLLCLPCVLPRRWPPPATTGPCAAAVRRPRRREPSLGRAGLSCAVLSRATPWPPVGSRGPVVDRLGGPGPRWTGALVPLTGKGGRDGVWMGPATAYAASGFT

SEQ ID NO: 4947 - protein, 415 aa, Glycine max
  unsure (1)..(415): unsure at all Xaa locations
MKISDENSSKPINPTSFQGGIECVGNRKMGQNRRALSVINQDLVAEGRPYPCVVNKRALAEKHNVCEKKQADPGHRPITRRFAAQIASTQKNRAEGTKKSNLGNSNSNGFGEHIFVDEEHKSTTDDQPVPMSLEKTEPMHSESDQMEEVEMEDIIEEETVLDIDTCDANNPLAVVDYIEDLYAHYRKLEGTSCVSSDYMAQQSDINERMRAILIDWLIEVHDKFDLLHETLFLTVNLIDRFXAKQTVARKKLQLVGLVAMLLACKYEEVSVPVVGDLILISDKAYTRKEVLEMEKLMVNTLQFNMSVPTAYVFMKRFLKAAQADRKLELLAFFLVELSLVEYEMLKFPPXLICKTCEWHSNYSEDQLLECSTLMAAFHQKAGNGKLTGVHRKYCSSKFSYTAKCEPARFLLENPL

SEQ ID NO: 4948 - protein, 271 aa, Vibrio logei
VAVNELSQPEAMAHLFQYDSTHGRFQHKVTHDQEYLYIDLPAGSQDKVRILHQADLSLLPWQSLEVDLILDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHEPHSAIVD

SEQ ID NO: 4949 - protein, 393 aa, Listeria monocytogenes EGD-e
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQACVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 4950 - protein, 477 aa, Bryocladia cuspidata
KNERYESGVIPYAKMGYWDPNYVIKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIRGFYNTLLEPYLDINLPQGIFFQQDWASLRKVTPVASGGIHCGQMHQLLDYLGNDVVLQFGGGTIGHPDGIQAGATANRVALEAMVIARNEGRDYVAEGPQILQDAAKTCGPLQTALDLWKDITFNYTSTDTADFVETPTANV

SEQ ID NO: 4951 - protein, 250 aa, Zea mays
  unsure (1)..(250): unsure at all Xaa locations
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGLRPFGVSFLFAGWDKHHGFQLYMSDPSGNYGGWKAAAVGANSXAAQSMLKQDYKDALTREEAVGLALKVLSKTMDSTSLTAEKLELAEVFLQPDTGEVQYQVCSPEALGKLLAKSGLTQPTPEA

SEQ ID NO: 4952 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 4953 - protein, 435 aa, Glycine max
  unsure (1)..(435): unsure at all Xaa locations
MGADDFEPLTMIGKGAFGEVRVCREKATGHVYAMKKLKKSEMLRIFQVEHVKAERNLLAEVDSNCIVKLYYSFQDEXEYLYLIMEYLPGGDMMTLLMRKDILTEDEARFYVGETVLAIESIHKHNYIHRDIKPDNLLLDRNGHMKLSDFGLCKPLDCSNLQEKDFSVGMNRSGALQSDGRPVAPKRTQQEQLQHWQKNRRMLAYSTVGTPDYIAPEVLLKKGYGVECDWWSLGAIMYEMLVGYPPFYSDEPMLTCRKIVNWRTTLKFPEEAKLSAEAKDLICRLLCNVEQRLGTKGADEIKAHPWFKGVEWDKLYQMKAAFIPEVNDELDTQNFEKFEEADKQTVPSSKAGPWRKMLSSKDVNFVGYTYKNYEIVNDAELPEIAELKKKSTKPKRPSIKSLFDDESATAANQPVQGSFLKLLPTQPEVPEKSESQ

SEQ ID NO: 4954 - protein, 63 aa, Alexandrium tamarense
MRGILADWLVEVAEEYKLCADTLYLSVNYIDRFLSIHPVQRSNLQLVGIACMWIASKYEEIYP

SEQ ID NO: 4955 - protein, 351 aa, Zea mays
MDQSFGNLGAGAGSSSGGSNSKAAATAVSSSSFLQLPLSTASPAYYGAPLALLHHAAAAPSSSQQHQQQQHHHHYARHGAEMSAAEAEAIKAKIVAHPQYSALLAAYLDCQKVGAPPDVLERLTAMAAKLDASAAGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMRDGMYRLGS

SEQ ID NO: 4956 - protein, 186 aa, Triticum aestivum
  unsure (1)..(186): unsure at all Xaa locations
TRPILMALLIGNMQTYLQSMTLRMEEMRLKRRDSEEWMRHRHLPDDLRERVWRHNQYKWLETRGVDEDGLVSCLPKDIRRDVKRHLCLRLVRRVPLFANMDERLLDAICERLKPSLCTETTYVVREGEPVDEMFFIIRGRLESSTTDGGRVEFFNKGLLKEXGDFCGEELLTWALDPKAAANLPLS

SEQ ID NO: 4957 - protein, 478 aa, Emericella nidulans
MNENDENGPSTRLTRAKAAALTTDAPAANGALKKPLQTKKAATGANGTQRKRAALGDVSNVGKADNGETKDAKKATSKTGLTSKATMQSGGVQKLSRSNLSRTAVGAKDNNVKKPATEAKRPGSGSGMGSAMKRTSSQKSLQEKTIQQEEPPRKKVDIEKVVEKQAEAVSVKGDVKAGAQTEELEKPQDFVADLDTEDLDDPLMAAEYVVEIFDYLRELEMETLPNPDYIDHQPDLEWKMRGILVDWLIEVHTRFRLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWDATLAHYAGYTEEEIDEVFRLMVDYLHRPVCHEAFFKKYASKKFLKASIMTRQWAKKYHHLYIDSALTEPYNSIKDNE

SEQ ID NO: 4958 - protein, 355 aa, Bifidobacterium longum NCC2705
MTIATPERYAEMLEAARRGGYAYPAINVTSSQTLNAALKGFADAESDGIIQISVGGAAYVSGRGVNDRVTGSLALAAFAHEVAAKYPNITIALHTDHCAKQYLDEWARPLLAHEADQVARGQEPTFQSHMWDGSTVPLKENLDIAEELLDKSQKAHTVLEIEIGAVGGEEDGHSAEINEKLYSTPEDGLEVARRLGLGERGRYMAAFTFGNVHGAYKPGVVKLRPSLLGDIQARVARAVAEGELPSAAGIVDFPNGKPFELVFHGGSGSRPEEIAEAVSYGVIKMNIDTDTQYAFTRPIADHVFENYDKVLKIDGEVGEKKFYDPRSWGRKAEDSMSARVVEACRQLGSAGKALK

SEQ ID NO: 4959 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 4960 - protein, 506 aa, Dechloromonas sp. RCB
MLYASPGTAGAKIAYKAQYDNFIGGKWVAPVNGQYFDVVTPISGKPYTKAARSTAEDMELALDAAHAAFPTWGKTSAADRANVLLKIADRLEANLELLAYAETVDNGKAIRETLNADIPLAVDHFRYFAGCLRAQEGGISEIDENTMAYHIHEPLGVVGQIIPWNFPILMAAWKLAPAIGAGNCVVLKPAESTPISILILAELIADILPAGVLNIVNGYGREAGMPLATSKRIAKIAFTGSTSTGRVIAQAAANNLIPATLELGGKSPNVFFADIMDKDDSFLDKAVEGMVLFAFNQGEVCTCPSRALIQESIYEKFMERVLKRVAAIKQISPLDTDCMMGAQCSQEQMTKIQSYLELGKQEGAECLIGGERAHLGGDLEGGYYIQPTMFKGHNKMRIFQEEIFGPVLAVTTFKDEAEALAIANDTIYGLGAGVWSRNGNVAYRMGRAIQAGRVWTNCYHAYPAHAAFGGYKESGIGRETHKVMLDHYQQTKNLLVSYSETKLGFF

SEQ ID NO: 4961 - protein, 455 aa, Novosphingobium aromaticivorans
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMARGFGGDFRPGGAGHPLCRRTASDPHRQRHALWPRRLFLCSRRGPDLAGDGSARIRDGRRQRRHHFHRSRAVRRDQAFGPGPRGIAPWPR

SEQ ID NO: 4962 - protein, 472 aa, Gelidium robustum
ESGVIPYAKMGYWDPNYAIKETDVLALFRITPQPGVDPIEASAAVAGESSTATWTVVWTDLLTACDLYRAKAYKVEEVPNSEDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 4963 - protein, 332 aa, Synechocystis sp. PCC 6803
MTTQLDRVVLIGVAGDSGCGKSTFLRRLTDLFGEEFMTVICLDDYHSLDRQGRKAAGVTALDPRANNFDLMYEQIKTLKSGQSIMKPIYNHETGLLDPPEKVEPNKVVVIEGLHPLYDERVRELVDFGVYLDISEEVKINWKIQRDMAERGHTYEDILASINARKPDFTAYIEPQKQYADVVIQVLPTRLIEDKESKLLRVRLVQKEGVKFFEPAYLFDEGSTIDWRPCGRKLTCTYPGIKMYYGPDNFMGNEVSLLEVDGRFENLEEMVYVENHLSKTGTKYYGEMTELLLKHKDYPGTDNGTGLFQVLVGLKMRKVYEQLTAEAKVPASV

SEQ ID NO: 4964 - protein, 303 aa, Triticum aestivum
  unsure (1)..(303): unsure at all Xaa locations
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILXYTEHQVVSSDFNSDTHSSTFDAGAGIAL

SEQ ID NO: 4965 - protein, 195 aa, Glycine max
MTTAPSLTGPLSNAVGFSDWKKHAPLSASLCKLSSSSNIVDMKISRCGCRKVGHGQRCFRLYALFGGKKDNNGKSDDVPSKAGILGNMQNLYETVKKAQMVVQVEAVRVQKELAAAEFDGYCEGELVKVTLSGNQQPVRTEITEAAMELGSEKLSLLITEAYKDAHQKSVQAMKERMNDLAQSLGMPPGLSEGLK

SEQ ID NO: 4966 - protein, 342 aa, Chlamydophila pneumoniae CWL029
MDSSAPYNIASQGTEKSTVERILDLYGPASCIKFLKQMVLIREFEARGEEAYLEGLVGGFYHSYAGQEAVATAAIANTGLDPWVFSSYRCHALAILLNIPLQEIAAELLGKETGCALGRGGSMHMCGPNFPGGFGIVGGQIPLAAGAAFTIKYQEQKNRVSLCFIGDGAVAQGVFHETLNFVSLHQLPLMLIIENNGWSMGTSLNRAVAKQPIAESQGSSYDIRAVTVNGFDLFNSLLGFREAYRYMVDTESPVLVECLCSRFRGHSISDPNLYRSKEEMQCLFKKDPIVLAKDWLIRLEVLTEEEFQNIRQECKTAVLEAFSNAKLSSDPSVTTLEEGVYA

SEQ ID NO: 4967 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFGQKLLDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 4968 - protein, 182 aa, Glycine max
  unsure (1)..(182): unsure at all Xaa locations
MADKDEELAMPRDAKIVKSLMKSMGVEDYEPRVVHKFLDLWYRYIVDVLTDAQVYSEHADKSEIDCDDIKLAIXQSKLNFSFSQPPPXREVLLELAHNRNKIPLPKTIAGPVIPLPPDQDTLISPNYMFAIPNQRPAEPPIEETEDEEDTNTIPNPSQEEQIVMQQNSPQRVSFPLPKRQND

SEQ ID NO: 4969 - protein, 326 aa, Nicotiana tabacum
GRIGRLVARVALQRDDVELVAVNDPFISTDYMTYMFKYDSVHGQWKHHELKVKDEKTLLFGEKSVRVFGIRNPEEIPWAEAGADFVVESTGVFTDKDKAAAHLKGGAKKVVISAPSKDAPMFVVGVNEKEYKPEYDIVSNASCTTNCLAPLAKVINDRFGIVEGLMTTVHSLTATQKTVDGPSMKDWRGGRATSFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKNFVKLVSWYDNEWGYSSRVIDLICHMASVA

SEQ ID NO: 4970 - protein, 162 aa, Oryza sativa
  unsure (1)..(162): unsure at all Xaa locations
MAPTVMASSATSXAPFQGLKSTAGLPVSRRSTNSGFGNVXNGGRIKCXXVWXIXGXKKFETLSYLPPLXVXDLLXXIXXLLXSXWVPCLQFXXVGFXYRENHRSPXXYXXRXWTXXXLPXFGCTDXTXVLXXLQEAXKXYPXAFVRIIXFHNXRXVXLXNFI

SEQ ID NO: 4971 - protein, 334 aa, Rhodospirillum rubrum
MALRACEIMPPSPPVPGAAFRSFPPVPGVFFDPYQKQSRGITMSRRVRKAVFPVAGMGTRFLPATKTMAKEMLPVVDKPLIQYAVEEAAAAGIDHFIFITGRGKSVLMDHFDHMPELEALLKERGKTDVLENLLGSMPSPGKVFSTRQQQPLGLGHAVWCARAFIGDEPFAVLLPDDLVLADTPCIKQLIDAHAQTGGNVVAVEDVPRERTNKYGILDVVEDNGTLARAKGLVEKPDSDKAPSTLAIIGRYVLDPGIFDLLENQNRGAGGEIQLTDAMNAQIKDVPFHGLRYEGARYDCGDKVGFLQANIAFALERPDMRDAVKAVLADFAKTI

SEQ ID NO: 4972 - protein, 497 aa, Eremothecium gossypii
MISIGGTLGTGLFIGIGQSLQSGPGTLLIGFLIVGVSIFCVIQSAAELSCQYPVSGSFSSHVSRFIEPSLGFTVSCAYALSWLISFPNELVGLAMTIGYWNEDIPPAVWVLIGYLLVIGLNLFAVRGFAESEFWLSIIKVLAIIIFLIIGIVIICGGGPNNKEGYLGGKYWHDPGAFRPPFFSSLCQTFVSAAFTFGGAELVLLTANESRKIESISRAAKGTFWRIAIFYISTVIVIGCLVPYTSPALDGESIRASPFVIALSNTGSFGTNVSHFMNAVIVAAVLSVCNSCVYAASRVIQSLGACGQLPEIFGYIDKKGRPLVGIGVCAVFGLLAFLVETTKVKDVFNWLFALCSIAAFFVWFCICVSQLRYRRALKVQGFPTEEIAYQSMLGKWSGVIGTLLNFLLICGEIYVSVKDGDVETFFQNCMSIPLLIIFYFCHRLYRRDWKTWLIPARDLDLNTGRKPEDLEMMKHELIVSRARIASSPWYYRAYRFWC

SEQ ID NO: 4973 - protein, 512 aa, Glycine max
TTTREREREMEDLEEEENGAEEVLGSSLTMEKVAAAKKFIENHYRAQMKNIQERKERRWVLERKLASSDVPNEERINLIKDLERKETEYMRLKRHKICVNDFELLTIIGRGAFGEVRLCREKKSGNIYAMKKLKKSEMLRRGQVEHVRAERNLLAEVASHCIVKLYYSFQDAEYLYLIMEYLPGGDVMTLLMREDTLSENVARFYIAQSVLAIESIHKHNYIHRDIKPDNLLLDKNGHMKLSDFGLCKPLDCIALSTLHENQTIDDETLAEPMDVDDADNRSSWRSPREQLQHWQMNRRKLAFSTVGTPDYIAPEVLLKKGYGMECDWWSLGAIMYEMLVGYPPFFSDDPITTCRKIVHWRNHLRFPDDAQLTLEAKDLIYRLLCDVDHRLGTRGANEIKAHPWFKGVEWDKLYEMEAAFKPQVNGELDTQNFMKFDEVDPPTAARTGSGSSRKMLTTKDLSFVGYTYKNFDAVKEGLRQSFGDSMQEYASKRAAEETSLQMLASSGDPMVP

SEQ ID NO: 4974 - protein, 507 aa, Oryza sativa; identical to SEQ ID NO: 560

SEQ ID NO: 4975 - protein, 340 aa, Microtetraspora sp. ATCC 39727
MPIATPEIYAEMLDRAKAGGFAYPAINVTSSQTLHAALRGFAEAESDGIVQVSTGGAEFLSGATIKDMVTGATALAEYARVVAAKYPVTVALHTDHCPKDKLDGFMRPLIDISLERVSKGLDPLFQSHMWDGSAVPLDENLEIAKELLDKCARARIIMEMEIGVVGGEEDGVVGEINEKLYTTAEDALATAEAVGVGDKGRYMLAATFGNVHGVYKPGHVKLRPSVLKEIQDAVGAKYGKDKPFDLVFHGGSGSLLEEIQEAISYGVVKMNVDTDTQYAFTRPIAEHMFKNYDGVLKIDGDVGNKKTYDPRSYGKAAEAGMAARVLEACQSLKSAGTKIS

SEQ ID NO: 4976 - protein, 248 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 4977 - protein, 309 aa, Triticum aestivum
MTPPSPHHDPTAAPIMPPLLLAALALALALSHAAAGGGTGFYDPARVTQISWRPRAFLYSGFLSHAECDHLIKLAKGRLEKSMVADNESGKSVMSQVRTSSGTFLSKREDEIISGIEKRVAAWTFLPEENAESMQVLHYEVGQKYDAHFDYFSDKKNVKRGGHRVATVLMYLTDVKKGGETVFPIAEGRDLQHKDETWSERARHGLAVKPRKGDALLFFSLHVNATTDPSSLHASCPVVEGEKWSATKWIHVRSFDNPPDVMTDARCSDDNEQCPRWAALGECYKNAKYMVGTKDTLGSCRKSCGVCDA

SEQ ID NO: 4978 - protein, 487 aa, Fusarium oxysporum
IVYYPGKGKLATSSDNAIKLSTSAGTVIGQLGFGMLADIVGRKRMYGLELIVIIFATLAQALTAGSPSTSLVGLIIFWRVVMGVGIGGDYPLSSIITSEFATTKWRGAMMAAVFAMQGIGQLVAALVMMFLTLGFKSSLESAPDTKHCTGDCQVAVDKMWRTLVGFGAVPACIALYYRLTIPETPRYTFDVARDVEQADEDVKAYMTGKREGDTDEIARAQVHASAKSNLQVPKASWSDFCQHYSKWKNLSILIGTAGSWFCLDVAFYGLSLNNGTILKVIGYSSKDANNMYEFLYNTAVGNIIIVLAGAVPGYWVSVATIDTLGRKTIQLGGFIILTILFIVMGFAYNHISSNGLLAIYVLAQFFFNFGPNTTTFIVPGEVFPTRYRSTSHGIFAASGKIGSIIGQGAISILRTHGATDKNEAPWMDHVLEIYALFMLLGIFTTLLIPETARKTLEELSGEDDYANNPETTIDSEAHAGKNEGTSV

SEQ ID NO: 4979 - protein, 569 aa, Neurospora crassa
MSTPQKTAGGNNAYHNFYNDFLHIKDPNERRRLALAEVDRAPFGWYHVRAVAVAGVGFFTDSYDIFTVSLLTLMLGIVYFQAKARCLQPPTQPSSSQHRPARSLGRSASAPLLMSLVVRACTDWNCCSSSLPLSLRPWLRVTFHQHHRYHYLLACSYGGRYRWRLSSFQYITSEFATTKWRGAMMGAVFAMQGLGQLAAAFVMLFVTLGFKKSLEAAPTLASCTGDCAVAVDKMWRTVIGVGAVPGCIALYYRLTIPETPRYTFDVKRDVEQASDDIEAFKTGKPKGQPDEATRIVAKQEAEKEMEIPKASWGDFFRHYSKRKNAMLLAGTALSWCFLDIAYYGVSLNNATILNVIGYSTTGAKNTYEILYNTAVGNLIIVLAGAVPGYWVTVFTVDTVGRKPIQFMGFGILTILFVVMGFAYKHLSPHALLAIFVLAQFFFNFGPNATTFIVPGEVFPTRYRSTSHGLSAAMGKIGSIIGQGAIAPLRTRGAVKGGNPNPWMNHVLEIYALFMLLGVGTTFLIPETKRKTLEELSGEFDMSGEEEAQRDTTLTEHKTEAPTSSAAVNA

SEQ ID NO: 4980 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 4981 - protein, 559 aa, Schizosaccharomyces pombe
MNRLNPFSKSHSKNSNENNEVSLADVAESDTRRHWLGLTKREFKLMGFAGAGFFLDSYDLFIINLVSPIYEYLYWGGLEGKKPHYPSGIHGLVNAAANIGNVFGQILFGFMGDFFGRKFVYGKEMIVVIIATVLVIALPKSIPTPLGKMMWIFAWRWLLGLGIGGDYPMSATITSERSLLSRRGTLLSIVFSFQGFGTLAGAIVTIILLACFEKPLNQRGEYTKLEGVWRLQMGLALVPALLVLIPRLTMKESKSYEQSKALNKYTDNDTYIADDDEPKKDNQNVVEEKQINLTTSSDSHPTSTEDFGDKRASTVPTSENTSGFIEYFSQWHHFKHLLATAVSWFLLDIAFYGVNLNQSVILKAIGFSSGKNEYHTLMRGAIGNLIIAIAGYVPGYWFTVFLVEKLGRKWIQLQGLFITGLMFAILAGSWDTISTGGRFACFVIAQFFSNFGPNATTFLYPAEVFPARVRGTAHGLSAALGKCGAILASLLFNFLTSVIGYGNVMWIFCGCMWGAIFFTLLLPETKMRDADEIDREEVLRGGNGKTHQGRWSWYFNGIF

SEQ ID NO: 4982 - protein, 234 aa, Haemophilus influenzae
MHSFSQRRTFMKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPAMPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 4983 - protein, 354 aa, Campylobacter jejuni subsp. jejuni NCTC 11168
MGVLDIVKAGVISGDELNKIYDYAKAEGFAIPAVNVVGTDSINAVLEAAKKVNSPVIIQFSNGGAKFYAGKNCPNGEVLGAISGAKHVHLLAKAYGVPVILHTDHAARKLLPWIDGLIEANAQYKKTHGQALFSSHMLDLSEESLEENLSTCEVYLQKLDALGVALEIELGCTGGEEDGVDNTGIDNSKLYTQPEDVALAYERLGKISDKFSIAASFGNVHGVYKPGNVSLQPEILKNSQKFVKDKFALNSDKPINFVFHGGSGSELKDIKNAVSYGVIKMNIDTDTQWAFWDGVREYELKNRAYLQGQIGNPEGDDKPNKKYYDPRVWLRSGEESMIKRLEIAFEDLNCINKN

SEQ ID NO: 4984 - protein, 553 aa, Shigella flexneri 2a str. 2457T
MLAGIAIGPWGLGFISDVDEILHFSELGVVFLMFIIGLELNPSKLWQLRRSIFGVGAAQVLLSAALLAGLLMLTDFAWQAAVVGGIGFAMSSTAMALQLMREKGMNRSESGQLGFSVLLFQDLAVIPALALVPLLAGSADEHFDWMKIGMKVLEFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMAPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 4985 - protein, 204 aa, Glycine max
  unsure (1)..(204): unsure at all Xaa locations
RIARAQTLLALCSTVPWYWFTVALIDIMGRFTIQLMGFFFMTVFMFALAIPYNHWKNHNNIGFVVMYSFTFFFSNFGPNATTFVVPAEIFPARLRSTCHGISAAAGKAXAIVGAFGFLYAAHTVGAFGLYAESTNPDKVDHGYPXGIGVKNSLIVLGVITFFGMVFTLLVPESKGKSLEELSGENEDDGAEAIEMAGSARTVPV

SEQ ID NO: 4986 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASMFEDVYKEMPDHLRRQRQELGV

SEQ ID NO: 4987 - protein, 196 aa, Mitthyridium sp. Wall 3890
GGAKKVVISAPSKDAPMFVIGVNEDKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSRSSIFDAKAGIALSDTFVKL

SEQ ID NO: 4988 - protein, 286 aa, Streptomyces rochei
MTTFSFEFFPPKTAAGEQALWRAVRRIEPLAPDFVSVTYGAGGSSRERTIQLTQRMVTETTLRPVAHLTAVGHSTAELRRIIGQYADAGVRDVLVLRGDPPGDPRGPWQPHPEGLTHACQLVELVRSLGQFTIGVAAFPERHPRSPDWDSDIRHFVAKCRAGADYAITQMFFDVEDYLRLRDRVEAAGCTTPIIPEIMPATDVRQIRRFAELSDAAFPEDLAHRLEAARERPDDAYRIGVEHATAMADRLLAEGAPGLHYITLNKSTAALDIHRNVLSRSRSLHAR

SEQ ID NO: 4989 - protein, 816 aa, Microbulbifer degradans 2-40
MNSKLPLPKLSNDEKQVSQDLHRHYNFTLGRFDSDADKGYLLEALAYTVRDRLMERWRLTVEKENLAKSKKVFYLSLEFLLGRSLSNAMLNLDMEESVKKSLMEFGADLEELEGEEKDAGLGNGGLGRLAACFMDSCASLQLPVMGYGIRYEYGMFHQSLREGRQVEQPDHWLRDGNPWEIERPDHVRHIKFYGHTEFYKNDNGKECARWVNTRDVLAVPFDMPIPGYQNDTVNTLRLWKAEATDEFNLQEFNEGDYADAVAEKNKAEQITMVLYPNDSSENGKELRLRQQYFLASASLQDVIADWVKENGEDFTNFAKQRCFQLNDTHPTLAVAELMRILMDDYWLEWDEAWAITTQTMAYTNHTLLPEALEKWSVRLVGELLPRLLDIIYEINARFMAEVAHRWPGDTARQRRMSIIEDGHESYVRMAYLAIVGSFSVNGVAALHSQLLVDGLFNDFYQLWPHKFNNKTNGVTPRRWLAHCNKDLATLISGSIGDKWVTDLSDIVKLEKFAEDKLFRDKWHAVKQANKVKLASLVKQKCDVDFNPEWLFDVQVKRIHEYKRQLLNILHVIHLYDKITRGDGDDVDPRCVLIGGKAAPGYVLAKLIIKLTNNVAKVVNADERVAKKLKLAFIPNYRVSSMEIICPATDLSEQISTAGKEASGTGNMKFMMNGALTIGTYDGANIEIMDAVGPEHFFLFGLRVEDIPQYRLHHSPCSIIEQDEDLARVIKLIECGHFSMFEPNIFDPILHSIRNANDPWMVAADFRSYIDAQAAAARAYQDRDSWVTSSIMNTARSGRFSSDRTISEYAKEIWKVK

SEQ ID NO: 4990 - protein, 651 aa, Agrobacterium tumefaciens str. C58 (Cereon)
MVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 4991 - protein, 66 aa, Brassica rapa
  unsure (1)..(66): unsure at all Xaa locations
VGGGIGATLKMIVSKYPTLKGXNFDLPHVIEXATSHPGIEHVGADMFVSVPEGDAIFXKWICHDWS

SEQ ID NO: 4992 - protein, 162 aa, Glycine max
  unsure (1)..(162): unsure at all Xaa locations
MASMAAIGSLNVPCSASSRSSNVGRKSFPRSLSFSASQLCGDKIHTDSVSFAPKIGRNPVIVTPKAVSDSQNSQTCLDPDASRSVLGIILGGGAGTRLYPLTKKRAKPAVPLGANYRLIDIPVSNCLNSNVSKIYVLTQFNSASVNRHLSRAYASXMGGYKN

SEQ ID NO: 4993 - protein, 380 aa, Vibrio vulnificus CMCP6
MKKLSKLLISAAIALPLMFTLLAKVGVADTMDKTAPNLASLPVATLAGGCFWCTESDLEKLNGVYDVVSGYSGGEMANPTYRQVSSGKTGHIEVIQFRYDPNVVSYEAVLDYFLRHIDPTDDKGSFVDRGPQYRPAIFYHTAEQKQIAERFLKEVDEAKIYPKPIKTELIEYTAFYPAEQYHQDYYKKSSLKYKYYRHASGRDQYLDKVFGDDRIEQPKTLRQLIDEKALTKNAKTYSRPSDKEIKAQLTDLQYYVTQKEGTERPFNNEYWDNKEAGIYVDIVSGEPLFSSTDKYKSGTGWPSFTKPISSAYIVTKTDYKLLYPRTEVRSKFADSHLGHVFDDGPAPTGLRYCMNSAAMKFIPVAQMEKMGYGEYLTLFQ

SEQ ID NO: 4994 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGWE

SEQ ID NO: 4995 - protein, 197 aa, Oryza sativa (indica cultivar-group)
MGGGKDKHDESDKGLFSNMMHGVAGGHGYPPHQGYPPQGYPPPPGAYPPPPGAYPPPPGAYPPPPGAYPPQHGYPQPGGYPPPGGYPQHGGYPPAGYPGSSGHQGGHGSSGGGHMGAMLAGGAAAAAAAYGAHKISSHGHGGHMGYGGHGGFGGYGHGYGGHHGGKFKHGKHGHHGKFKHGKHGHGMFGGGKFKKWK

SEQ ID NO: 4996 - protein, 228 aa, Zea mays
MPLWGAAASAAPAADGDAARAPSGSGGGVKVIRSLLPTRRRLRLDPPAKLYFPYEPGKQVRSAVRIKNISKSHVAFKFQTTAPKSCFMRPPGGVLAPGESIIATVFKFVEHPENNEKPMDKCKVKFKIVSLKVKGPVEYVPELFDEQEGQVPVEQILRVVFLDAERPSPQMDKLKRQLAEAEAALEARKKPPEDNGPRIVGEGLVIDEWKERRERYLARQQIEGVDSV

SEQ ID NO: 4997 - protein, 382 aa, Microbulbifer degradans 2-40
MNSMFAETEEKSFDIKLFEKTTHNPSFASLTNHFRTTNGLKDYCIPVNSYFPPAHIMDELFRRLPYALKYYPSSNESIADNIALFSGVTNPNWIVAGNGSTEIISWLNSIFIKESIFVPVPSFGRWVEEPMGLGVDVKTMPHSDDMLQKITAESYVAEVLASKARNAVICNPNNPTGTLFSREEILWILERLTHLDNIIIDESFIDFSAENPPSVKNDVANFNNVWVLKSLGKNLGLHGVRMGYAISCEANIQRMKKHLPYWNVNGITEMLLSLIKTEQKAYDESRLKNINDAIYLSECVEQIREFTVFPTHSNFIFVKLSDEFDGEELRNRMLQDHACLIRNCGNKLGASKQYFRIAARPVEDIHYLVAALKDVLAGMKVE

SEQ ID NO: 4998 - protein, 289 aa, Thermobifida fusca
MALARLGVPSSLLARMSTDRFGQQLRAYVGSRGVSTRDIVVSDEPTTLAIATLDETGRATYDFYVKGTVDWQWRPEELPDPLADDVTAIHVGSLAMAMPPGAAVVEEWVARQRGRAVISYDPNIRPALAGTPASARERVERQVALADLVKVSDEDVYWLYEQDPATGSADLLVEVGRSWLRRGPSLITITCGGDQTLVLVRGREDRPLSVAPEPVDVVDSIGAGDAFCAGLLDALGQAGALGADGRERLAALTDAQLTVCVAHAHRVAAHTCRRVGADPGELDFPPLEF

SEQ ID NO: 4999 - protein, 474 aa, Streptococcus pneumoniae TIGR4
MTRYQNLVNGKWKSSEQEITIYSPINQEELGTVPAMTQTEADEAMQAARAALPAWRALSAVERAAYLHKTAAILERDKEEIGTILAKEVAKGIKAAIGEVVRTADLIRYAAEEGLRITGQAMEGGGFEATSKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 5000 - protein, 184 aa, Triticum aestivum
  unsure (1)..(184): unsure at all Xaa locations
ATSVAPFQGLKSTAGLPVSRRSNGASLGSVSNGGRIRCMQVWPIEGIKKFETLSYLPPLSTEALLKQVDYLIRSKWVPCLRXSKLXHLPVEHNAXPGYYDGPGIGMWXLPXFGCTDXTQVINKWRRSRRYPDAIPHNFTTQAVALSNCKIRKAKHNILHSFECLVPPNYFYCKLFHFKWSKTSH

SEQ ID NO: 5001 - protein, 296 aa, Oryza sativa
  unsure (1)..(296): unsure at all Xaa locations
MVHCQGAGRSSIGMKPPLCLDMDRMSGLRERDVSRIRTLLDGIGRSSSLAPRRGFFAIYATGFNFLDFHYYEVFATVGGNRVTTYSSLKDGNFAILQAYIDEDKDESFYTLSWACDLDGTPLLVAAGSNGIIRVINCATEKLLKTFVGHGDSINEIRTQALKPSLIISASKDESVRLWXNVHTGICILIFAGAGGXHRNEVLSVDFHPSDIYRIASCGMDNTVKIWSMKEFWPYVEQSFTWTDLPSKFPTKYXNFPVLGAVVHSNYGDCTRRLGDFILSKRXDNENVLWEPKTKNQ

SEQ ID NO: 5002 - protein, 97 aa, Glycine max
  unsure (1)..(97): unsure at all Xaa locations
KKIREKLRRANVQFLSAPIKDGTTGTVIVLTTPDAQRTMLAYQGTSSTVNYDACLANAXSKTNILVGERYLFEPPXSIKTNTKACEKARSNGALVAI

SEQ ID NO: 5003 - protein, 443 aa, Prochlorococcus marinus str. MIT 9313
MAAAAVIGDYRRGKTALFLIACGWAGAAPHLWLEAGRSLLPAITLAFVLGGYGLRTVLRDRQHSSANANEIGLEPSAEYVWPSVDVLVAARDEEAVVDRLVERLAGLNYPKGKLSTWIIDDGSQDRTPALLDELQQQFPSLNVIHRPSGAGGGKSGALNAALQQLQGEWLLILDADAQLQDDLLQRLVVFAQQGGWSAVQLRKAVINSQHNLLTRVQAMEMAMDALIQQGRLAGGGVVELRGNGQLIQRSTLEACGGFNENTVTDDLDLSFRLLTAGALVGIVWNPPVQEEAVESLSALWRQRQRWAEGGLQRFFDYWPVLMSSKLTLAQRRDLACFFLLQYALPVVSFADLFTTLLTRTIPTYWPLSIVAFSISGMAYWRGCRSISDGPALPSPTPWNLVVAITYLSHWFVVIPWVTVRMALFPKSLVWAKTSHHGQQPVQV

SEQ ID NO: 5004 - protein, 460 aa, Myriogramme sp.3
WDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKALGTVIIMIDLVIGYTAIQSMAIWSRKNDMILHLHRAGNSTYSRQKIHGMNFRVICKWMRMAGVDHIHAGTVVGKLEGDPLMIKGFYDTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 5005 - protein, 184 aa, Nostoc sp. PCC 7120
MQYLGELASEFPVASDIQVFRNDKITLDEIRGLNPDAIVISPGPGRPEDAGISLNLIQELGTNLPILGVCLGHQSIGQVFGGNIVSAPELMHGKTSQVTHTGVGVFQGLENPMIATRYHSLVIDRPTCPEVLEITAWVDDGTIMGVRHRNYPHIQGVQFHPESVLTSLGKQLLRNFLEQLQLRE

SEQ ID NO: 5006 - protein, 257 aa, Oryza sativa
  unsure (1)..(257): unsure at all Xaa locations
ISELSSALQWAVTTSVDFSLAQLIQVIILLSTGGNNGGGYMASKYVVIAFHAAILLSHAAINSLPITWLSFFGQFAAAWNMLGVFVLMIAVPTVATERASAKFVFTHFNTENNAGIHSNFYIFVLGLLMSQYTLTGYDASAHMTEETKNADRNGPIGIISAIGISIIVGWGYILGITFAVKDIPYLLNPENDAGGYAIAEVFYLAFKSRYGSGIGGIICLGIVAVAIYFCGMSXVTKHSGMGVRVSRDXAMPLSSVW

SEQ ID NO: 5007 - protein, 343 aa, Oryza sativa (japonica cultivar-group)
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 5008 - protein, 357 aa, Prochlorococcus marinus str. MIT 9313
MRQHRIVLLPGDGIGPEITAVAKLLLDALGHQHGFKLNFEQHPIGGVAIDASGSPLPASTLEACQASDAVLLAAIGSPRFDALPREQRPETGLLSLRAGLKLFANLRPVTILPALIDASSLKANVIKGVDLMVVRELTGGIYFGQPKGRIEADGDERAFNTMTYSRTEVDRIAKVAFELARDRSGKLCSVDKANVLDVSQLWRDRVDALAANYGDVELSHMYVDNAAMQLVRNPRQFDVLLTGNLFGDILSDEAAMLTGSIGMLPSASLGSEGPGLFEPVHGSAPDIAGQDLANPMAMVLCAAMMLRIGLKENDAARALEGSVERVLAAGFRTGDLMSEGCTQLGCAEMGEQLLQAL

SEQ ID NO: 5009 - protein, 313 aa, Oryza sativa
  unsure (1)..(313): unsure at all Xaa locations
MACHYPDHGLAMDPSSAAASSPNPSFSPGGGGGAGXGGGEREKAAVAAHPLYERLLEAHVACLRVATPVDQLPRIDAQIAARPPPLAAASAAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLMLTEGERSLVERVRHELKNELKQGYKEKLVDIREEILRKRRAGKLPGDTASILKAWWQAHSKWPYPTEDDKARLVQETGLQLKQINNWFINQRKRNWHSNPASSGEKTKKKRNVTGDGGAEQSW

SEQ ID NO: 5010 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 5011 - protein, 341 aa, GIBBERELLA ZEAE PH-1
MASIIDTVKNTIAENFGGPAEQLATHQFSLSETPNLSGKVAVVTGGSEGIGYGVTHTLLTHDISKIFILSLSKEVVEGAKKSVAEELGQEKADRTEWVQCDLSNWAEVKKAADQIKDSTDRLDILVNNAGRGIQTYQLSSYGVDQHMATNHFGHVLLTSYLLELLKKTSEKHGIVRIVNQASNAHQGAPSDVKFESLEELNTDLGPNPQYGRSKLANILYTRYFDRNVTKAGSPKILMNATHPGFVSTRQSLEHIHEAYPLAGYAMSVGMEPFKKDQFQGATSAMYAATMTDKSGQYICPPAVPELGNEKSQDEKLGDQLMELTRKIISEKFESFDDRKFY

SEQ ID NO: 5012 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 5013 - protein, 260 aa, Chloroflexus aurantiacus
MHQDISLLANLAIALMVAFAGGLLARRIGLPTIVGYLLAGMAIGPFTPGFVGDVEDISQLAEIGVIFLMFGVGLHFSLKDLWAVRQVALPGAILQMTIATALGFALSQVWGWNPLSGLILGLSISIASTVVLLRGLMDNGLLSTSAGRIAVGWLVLEDLATVLILVLLPIIFGGQGEQSFLSGTFSLLKAALFVVVMLFIGRRLLPKLLDIIASTRSRELFILAAVAIALGTAFGAAAFFDVSLAPGGVSGRCSAERVTV

SEQ ID NO: 5014 - protein, 167 aa, Ipomoea nil
MDLRNFGLSNFGLEPQLLSTIQDMLDFADDHDRAGRAPPEQPIRAYVRDAKAMAATPADVKEYPNSYVFIADMPGVKAAEIKVQVEDDNVLVVSGERTEREKDEKDGVKYLRMERRVGKFMRKFVLPENANVEAINAVYQDGVLQVTVEKLPPPEPKKPKTVEVKVA

SEQ ID NO: 5015 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 5016 - protein, 465 aa, Neurospora crassa
MSGLLLPILRRPSSLISTGFVVKSPQPLVQPQRHHLHYSYRLMSAKLKPAARVAGNRQDVWTIVNEAAAASPRQPIVNMGQGFFGYNPPEFILNAAKKALDRVECNQYSPTRGRPRLRKALSKAYAPHWGRELDPETEITITTGANEGMLSAFMAFIEPGDEVIVFEPFFDQYISNIEMPGGKIVYVPMHPPKEGHIKTLSASEWTIDFDELERAVTPRTKMLVINTPHNPVGKVFSRAELERIAELCVKNQIIILSDEVYDRLFYTPFTRMATLSPEVEKITLTVGSAGKNFYATGWRVGWLMGPAELIQYVAAAHTRICYSSVSPLQEACAIGFEEADQQGFWTQCIEDMQNKMSRFNAIWDELGLPYSIPEGGYFVMANLNKVEIPEGYPFPPHVAERPRDFKLAWFLIQELGVAAIPPSEFYTDVNAHIVEDWLRFAVCKPDEVLEDAKERLRGLKKFIKQ

SEQ ID NO: 5017 - protein, 193 aa, Zea mays; identical to SEQ ID NO: 4210
  unsure (1)..(193): unsure at all Xaa locations

SEQ ID NO: 5018 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPDDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 5019 - protein, 219 aa, Arabidopsis thaliana
MSVVAINMNTINHLSKTCKTPNIQSPICFDRKPFSYSLIPLFPKTLNGFSSYSSSVSRRSRFIIPKRRRFSVSMEWQDCSVKMEVDVPVSVAYNFYLDRESFPKWMPFISSVQVLKDKPDLSRWSLKYNAFGQDIKYSWLARNLQPTPNQKIHWRSLEGLPNKGSVRFFPKGPSSCIVELTVSYEVPALLTPVASVLRPFIESLLRGGLERFAALAKTT

SEQ ID NO: 5020 - protein, 401 aa, Brassica juncea
MALKLNPLASQPYNFPSSARPPISTFRSPKFLCLASSSSPALSSSTKEVESLKKPFTPPKEVHVQVLHSMPPQKIEIFKSMEDWAEQNLLTHLKDVEKSWQPQDFLPDPASDGFEDQVKELRERARELPDDYFVVLVGDMITEEALPTYQTMLNTLDGVRDETGASPTPWAVWTRAWTAEENRHGDLLNKYLYLSGRVDMRQIEKTIQYLIGSGMDPRTENNPYLGFIYTSFQERATFVSHGNTARQAKEHGDLKLAQICGTIAADEKRHETAYTKIVEKLLEIDPDGTVVAFADMMRKKISMPAHLMYDGRDDNLFDNFSSVAQRLGVYTAKDYADILEFLAGRWKIESLSGLSGEGNKAQEYLCGLTPRIRRLDERAQARAKKGPKIPFSWIHDREVQL

SEQ ID NO: 5021 - protein, 338 aa, Moraxella sp. TAE123
MKAAVLHEFGQSLQIEEVDIPTPGAGEIVVKMQASGVCHTDLHAVEGDWPVKPSPPFIPGHEGVGLITAVGEGVTHVKEGDRVGVAWLYSACGHCTHCLGGWETLCESQQNSGYSVNGSFAEYVLANANYVGIIPESVDSIEIAPVLCAGVTVYKGLKMTDTKPGDWVVISGIGGLGHMAVQYAIAMGLNVAAVDIDDDKLAFAKKLGAKVTVNAKNTDPAEYLQKEIGGAHGALVTAVSAKAFDQALSMLRRGGTLVCNGLPPGDFPVSIFDTVLNGITIRGSIVGTRLDLQESLDMAAAGKVKATVTAEPLENINDIFERMRQGKIEGRIVIDYTM

SEQ ID NO: 5022 - protein, 244 aa, Oryza sativa
  unsure (1)..(244): unsure at all Xaa locations
MDKKQTSLGTPVYRTNPFDSDSDSEVPSRPSRAQSVPVRRTDQSIQELEDYAVDKVEETSRKVNDCVRAAEAIREDATKTLVTLHRQGEQITRTHRVAADIEHDLSMSEKLLGSLGGLFSKTWKPKRNQQIKGPISQNNSFTSSANHMEQRQRLGISSTRQPSPNQVHRSPATAIEKVQVEIAKQDDALSXLSNMLGELKGMALDMGTEIERQNKSLDAFGDDVDELNFRVKGANQRGRRLLGK

SEQ ID NO: 5023 - protein, 488 aa, Asperococcus fistulosus
  unsure (1)..(488): unsure at all Xaa locations
MPEDXQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLQINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 5024 - protein, 132 aa, Frankia sp. ACN14a
MFTKAEDVLRYIRDEDVQFIDVRFCDLPGIMQHFTIPTQVFAESVFTDGLMFDGSSIRGFQAIHESDMLLLPDPQTAFVDSFREHKTLAMTFFIHDPITKEQFSRDPRNIAQKAETFLRRTGIADTGYFGPE

SEQ ID NO: 5025 - protein, 447 aa, Methanosarcina barkeri
MVQIKKCITKEDVLEAVKERDVKFIRTQFTDTLGIIKSWAIPVEQLEEAFENGVMFDGSSIQGFTKIEESDMKLVLDPSTFRILPWRPTTGAVARILGDVYLPNGRPFEGDPRYVLKSAIEEAKKMGYSMNVGPELEFFLFKLDANGNPTTELTDHGGYFDFSPLDRAQDVRRDIDYTLERMGFQIEASHHEVAPSQHEIDFRFGDVLSTADNVITFKYVVKSIAYHKGYYATFMPKPLFGVNGSGMHTNQSLFKGDNNVFYDPESADQLSQEAMYYIGGLLNHIIEFAAVTNPVVNSYKRIVPGYEAPVYLTWSAKNRSSLIRIPETRGNGTRVELRCPDPSCNPYLAFALMLRSGLDGIKNKIDPGEPTNTNIFHLTEKEREGKGIRSLPADLKGAIDEMKGSKFVKEVLGEHVFNHYLCAKEMEWDEYKAIVHPWELEKYLHML

SEQ ID NO: 5026 - protein, 262 aa, Triticum aestivum
  unsure (1)..(262): unsure at all Xaa locations
MGNPEKLMXMIFDLKFTSKSLQRQARKCEKEEKEQKLKVKKAIEKGNVDGARIYAENAIRKRTEHMNYLRLASRLDAVVARLDTQAKMQAIGKSMGSIVKSLDSSLATRHLQKMSETMDPXQRQFVNMEVQAEFIEGAXAGSTSLSTPAPEANSLMQQAHAAASGRVVSVGPPPGPSPRPPARSRTTGRRSTGTTYARRLAELKARGLNYGLFTSLHFRYGFMHCLAPLRLEMVKGCSYLHNPVNILNGQVGLSGISMSMWN

SEQ ID NO: 5027 - protein, 536 aa, Glycine max
MASSLRISRLISRSFSSTSFFSRGGNGFLGSRHCKYSTSSAIEEEPVKPSVQVEHTQLLIDGKFVDAASGKTFPTLDPRTGEVIAHVAEGHSEDVDRAVAAARKAFDHGPWPKMTAYERQRILLRAADLLEKHNDELAALETWDNGKPYEQAAKIEVPMLVRLIRYYAGWADKIHGLTVPADGPYHVQTLHEPIGVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHESVYDEFVEKAKARALKRVVGDPFKGGIEQGPQIDSDQFEKILRYIRSGVESGATLETGGDKLGNKGFYIQPTVFSNVKDGMLIARDEIFGPVQSILKFKDLGEVVQRANNTRYGLAAGVFTTNMDTAYTLTRALRVGTVWINCFDTFDAAIPFGGYKMSGQGREKGEYSLKNYLQVKAVVNPLKNPAWL

SEQ ID NO: 5028 - protein, 803 aa, ASPERGILLUS NIDULANS FGSC A4
MRSLISVAVLSALPTAFSQANTSYTDYNVEANPDLFPLCLQHLNASFPDCASGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGGVDPETLKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYELALNNERSVVVKFELKGEEAVILSWPEDTTSDFVSSIDGGLDRKQDVIA

SEQ ID NO: 5029 - protein, 173 aa, Glycine max
ARGLEEEKSFQFHDVFNLDNENRAEDMPTLIDRKDNVFIISNPKSKYPVLQLDLRLISDLAVVIGSATCGGIAFACAGQPVMTGYLLARSIIGPGGLSFVSAMVQVETVAQFGVIFLLFALGLEFSTTKLLVARAVAILGGLLQIFLFMCLCGITASLCGGKSSEGIFVGAFL

SEQ ID NO: 5030 - protein, 195 aa, Zea mays
  unsure (1)..(195): unsure at all Xaa locations
MSSTYMKRMLQGIGSDQVIGKAAMDDEEHEVYGQEIPEDGDMDGADVDMAAAGDDAANVQELDEMKRKXEEMQGCDPSISTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPY

SEQ ID NO: 5031 - protein, 836 aa, Oryza sativa
MTQADQAVISLRPGGGGGIGGPRAGRLFPFGASTGSLDFLRPRGGASSGFAAKLGDLRFEPLERVRYTRDQLVELHEIIDIPENILKLKQDIDIELHGEDEPWINNDSSVQTQSYNRYAETDNRDWRSRIEQPVQTPAIGGEEKSWDKFREAKESYISSGKQDQFNNQDKLSSQFSAKAQVGPAPALVKAEVPWSIQRGNLSNKERVLKTVKGILNKLTPEKFDLLKGQLIEAGITTADILKDVISLIFEKAVLEPTFCPMYAQLCFDLNEKLPSFPSEEPGGKEITFKRVLLNNCQEAFEGADNLRSEVNKLTGLDQEMERRDKERLVKLRTLGNIRLVGELLKQKMVPEKIVHHIVQELLGSESNRCPAEENVEAICQFFNTIGKQLDENPKSRRFNDVYFNRLKDLTTNSQLASRLRFMARDVLDLRSNQWVPRREEMKAKKISEIHREAENNLGLRPGSTASIRTGRTGTGGGGPLSPGAFSMNQPGIVGMLPGMPGARKMPGMPGLGSDDWEVPHSRSKPRADPVRNLTPSLANKPSPNNSRLLPQGSAALISGKTSALVGSGGPLSHGLVVTPSQTTGPPKSLIPAPSVDPIVEQPAAAPKPSSTELQKKTISLLKEYFHILLLHEAQQCIEELKSPDYYPEVVKEAINLALDKGTNSIDPLLRLLEHLYNKNVFKATDLETGCLLYSSLLDELAIDLPKAPVHFGEVIGRLVLSHCLSIEVVEDTLKKIEDSFFRAAVFEAMMKIMKANPSGPYLCAAFSKSVASDPPALSMLAVAACRSAMLCWRLVRMPPLCARRSGAWRPRPSSPPPSLSCADSAPAGSSRTADGD

SEQ ID NO: 5032 - protein, 192 aa, Oryza sativa
MAGIRLTPEEPELPQGTPPRPQLPPMASDDERSVAADSWSVRSEYGSTLDDDQRYADAAEVLAAAAASANFPYSSDKDDQDPSEVEGSMLGLQSYWDASYSEDLANFQEHGHAGEIWFGADVMDTMAVWTKKLCIDIINGGTPSGNESINCEVDEKQLSNYPVLDVGTGNGLLLQALAKQGYNLISWLKFSS

SEQ ID NO: 5033 - protein, 526 aa, Oryza sativa
MAGDQMHVLSALDSAKTQWYHFTAIVIAGMGFFTDAYDLFCISLVTKLIGRVYYTADGASKPGSLPPNVSAAVNGVAFVGTLTGQLFFGWLGDRVGRKSVYGMTLLLMIICSVASGLSFGDTPTSVMATLCFFRFWLGFGIGGDYPLSATIMSEYANKRTRGAFIAAVFAMQGFGILAGGAVAIGITAIFRSRFPAPPFAADPAASTPPQADYVWRLILMFGALPAALTFYWRMRMPETARYTAIVAKNAERAAADMSKVLQVKITAEQAEMASPVDKPFTSKPFGLFSGEFARRHGFHLLGTTSTWLLLDIAYYSQNLFQKDIFSAIGWIPEAKTMSALDELYHIARAQTLIALCGTVPGYWFTVALIDVVGRFKIQAAGFFVMTAFMLALAVPYDHWTAAGNQIGFVVLYALTFFFANFGPNATTFIVPAEIYPARLRATCHGISAASGKVGAIVGSFGFLYLAQSPVPAKAAAHGYPPGIGVRNSLFALAGCSLLGFLLTFLVPEPKGKSLEEMSRENEVGQP

SEQ ID NO: 5034 - protein, 427 aa, Batrachospermum macrosporum
IEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGLIVERERMDKFGRPFLGATVKPKLGLSGKNYGRVVYEGLRGGLDFLKDDENINSQPFMRWRERYLFSIEGVNRAQAATGEVKGHYLNVTAGTMEDMYERAEFAKELGSIICMIDLVIGYTAIQTMAVWARKTDMILHLHRAGNSTYSRQKIHGMNFRVICKWMRMAGVDHIHAGTVVGKLEGDPLMIRGFYNTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADFV

SEQ ID NO: 5035 - protein, 551 aa, Sorghum bicolor
MAARRAASSVLSRFLLTRPSPSPSPASAASPAGKSALLGAGGPLHRFSTAPAAAAATAEEPIQPAVEVKHTQLLINGNFVDAASGKTFPTLDPRTGEVIARVAEGDSEDIDRAVAAARRAFDEGPWPRMTAYERCRVLLRFADLIERHAEEIAALETWDNGKTLAQAAGAEVPMVARCIRYYAGWADKIHGLVVPGDGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFVVMDDADVDQAVELAHQAVFFNQGQCCCAGSRTFVHERVYDEFVEKSKARALKRVVGDPFRNGVEQGPQIDGDQFNKILRYVQSGVDSGATLVTGGDRVGSRGFYIQPTVFADAKDDMKIAREEIFGPVQTILKFSGMEEVIRRANATHYGLAAGVFTRSLDAANTLSRALRAGTVWVNCYDVFDATIPFGGYKMSGVGREKGVYALRNYLQTKAVVTPIKDPAWL

SEQ ID NO: 5036 - protein, 431 aa, Zea mays
IGGVFGGLFNFLLDRILRAYSFINERGAPYKILLTVTISIITSACSYGLPWLAPCTPCPADAVEECPTIGRSGNFKNFQCPPGYYNGLASLFFNTNDDAIRNLFSSGTENEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPYMTHLVASDVVSGPLISFSGVERVGNIVQALRITGHNGFPVVDEPPLSEAPELVGLVLRSHLLVLLKGKGFMKEKMKTSGSFVLERFGAFDFAKPGSGKGLKIEDLDFTDEEMDLYVDLHPITNTSPYTVVETMSLAKAAVLFRALGLRHMLVVPKTPGRPPIVGILTRHDFIPEHIHGLFPNIHKSH

SEQ ID NO: 5037 - protein, 269 aa, Zea mays
  unsure (1)..(269): unsure at all Xaa locations
MSFHYHDHGLSMDAAAVGGRRRXSSPNPSGFSPGIGGEREKAAIAAHPLYERLLEAHAPAHASGGPSGGEELDLFMTHYVLLLCSFKEQLQQHVRVHAMEAVMGCWELEQSLQSLTGASPGEGTGATMSDDEDNQVDSEANMFDGNDGSDGMGFGPLMLTEGERSLVERVRQELKNELKQGYKEKLVDIREEIMRKRRAGKLPGDTASVLKAWWQAHSKWPYPTEDDKARLVQETGLQLKQINNWFINQRKRNWHSNPTSSGEKTKKKR

SEQ ID NO: 5038 - protein, 317 aa, Actinobacillus pleuropneumoniae serovar 1 str. 4074
MKVALLGAAGGIGQTLALLLKLRLPVGTDLALYDISPVTPGIAVDISHIPTSVSAVGYSGEDPSEALKGANLVIITAGVARKPGMTRADLFNINADIVKNLVEKVAEVCPKACIGIVTNPVNTLVPIAAEVLRKAGVYDKRKLFGVTTLDVVRAKTFTSELKEKHVETVKVPVIGGHSGPTILPLLSQALSEGLPLSFTQEEIEALTYRIQNAGTEVVEAKAGGGSATLSMAESGARFAVAVFKALLGEDCVRYAYVESKEGSGYPEFFAHPVRFGLTGVEELLPIGKLSEYEQAKLGELKPVLEADIALGKNFVNP

SEQ ID NO: 5039 - protein, 459 aa, Prymnesium parvum
DPDYVIKDTDILALFRCTPQPGVDPVEAAAALAGESSTATWTVVWTDLLTACDLYRAKAYRVDPVPSTPDTYFCYVAYDLDLFEEGSLANLTASIIGNIFGFKAVKALRLEDMRFPVALLKTYQGPATGLIVERERMDKYGRPLLGATVKPKLGLSGKNYGRVVFEGLKGGLDFLKDDENINSQPFMRYRERFLYSMEGVNHAAAMTGEVKGHYLNATAATMEDMYERAEFCKELGSVIVMIDLVIGYTAIQSMAKWSRKTDMILHLHRAGNSTYSRQKNHGMNFRVICKWMRMAGVDHIHAGTVVGKLEGDPLMIKGFYNTLLDFKSEMCLAEGLFFAQDWASLRKCVPVASGGIHCGQMHQLINYLGDDVVLQFGGGTIGHPDGIQSGATANRVALECMVLARNEGRDYISEGPQILRDAAKSCGPLQTALDLWKDITFNYASTDTADFVQTPTANV

SEQ ID NO: 5040 - protein, 488 aa, Litosiphon pusillus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLQINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 5041 - protein, 514 aa, Triticum aestivum
MEEWLLSLCFIALSTATVLAFWFLKLSGGKADPHKKQLPPGPWTLPVIGSLHHVISALPHRTMMQLSCRHGPLMLLRLGEVPAVVVSTADAAALVMKTHDLVFVDRPRSPTMDIASSGGKDIVFAPYGGHWRQMRKICVVQLLSSTQVSRMEGVRAEEVGSLLRDITAAASTGATINVSEKVMALTNDIVTRAVFGGKFARQCEFLREMDKAFKLVGGFCLADLFPSSRLVRWLSNGERDMKRCHGLIHHIIAEVVENRKAARASGVGRSIPGDEDMLDVLLTLQEDDSLEFPLTTETMGAVLHDVFAGATETTGNTLAWVISELMHNPHTMAKAQHEVRDVLGEGRSVITNSDLGELHYMPMILKEALRLHPPGPLIPRMAREDCTVMGYDIPKGTNVYINIFAISRDPRYWINPEEFMPERFENNNVNYKGTYFEFIPFGAGRRQCPGIQFSSSITEMALANLLYHFDWMLPDGANLASFDMSEKFGFAVSKKYDLKLRAIPHVWSNAMTLK

SEQ ID NO: 5042 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPEEFNQELGRLLENLRDRAVDDGPLQKYASGNATGPDFQAIYALVQCTPDLSRQSCFSCLSDAYGNMPRRPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERVKSKSIGSSRNEASITELYPR

SEQ ID NO: 5043 - protein, 510 aa, Mycobacterium tuberculosis CDC1551
MATQISHFIDGQRTAGQSTRSADVFDPNTGQIQAKVPMAGKSDIDAAVASAVEAQKGWAAWNPQRRARVLMRFIELVNDTIDELAELLSREHGKTLADARGDVQRGIEVIEFCLGIPHLLKGEYTEGAGPGIDVYSLRQPLGVVAGITPFNFPAMIPLWKAGPALACGNAFVLKPSERDPSVPVRLAELFIEAGLPAGVFQVVHGDKEAVDAILHHPDIKAVGFVGSSDIAQYIYAGAAATGKRAQCFGGAKNHMIVMPDADLDQAVDALIGAGYGSAGERCMAISVAVPVGDQTAERLRARLIERINNLRVGHSLDPKADYGPLVTGAALARVRDYIGQGVAAGAELVVDGRDRASDDLTFGLPEGDANLEGGFFIGPTLFDHVAAHMSIYTDEIFGPVLCMVRARDYEEALRLPSEHEYGNGVAIFTRDGDAARDFVSRVQVGMVGVNVPIPVPVAYHTFGGWKRSGFGDLNQHGPAAIQFYTKVKTVTSRWPSGIKDGAEFVIPTMS

SEQ ID NO: 5044 - protein, 197 aa, Pseudomonas putida KT2440
MLLMIDNYDSFTYNVVQYLGELGAEVKVIRNDEMTIAQIEALNPERIVVSPGPCTPSEAGVSIEAILHFAGKLPILGVCLGHQSIGQAFGGDVVRARQVMHGKTSPVYHRDLGVFASLNNPLTVTRYHSLVVKRETLPDCLEVTAWTSHADGSVDEIMGLRHKTLNIEGVQFHPESILTEQGHELFANFLKQTGGRR

SEQ ID NO: 5045 - protein, 373 aa, Candida albicans
MSVKTQTITVLPGDHVGTEIVNEPTKVLKAIEAPTPYQKIQFDFKHHLIGGAAIDATGVPLPDDALESAKSSDAVLLGAVGGPKWGTGTVRPEQGLLKIRKELNLYANIRPCNFASDSLLELSPLKAEVVKGTNLIIVRELVGGIYFGERQEQEESEDHQTAWYRPKYTVDEVTRITRMAAFMALQHNPPLPIWSLDKANVLASSRLWRKTVDKVISEEFPALSVQHQLIDSAAMILIQNPTKLSGIIITSNMFGDIISDEASVIPGSLGLLPSASLASLPDTNTAFGLYEPCHGSAPDLPANKVNPIATILSAASMLRLALDCVKETEALEEAVKQVLDSGIRTADLRGTSSTTEVGDAIAETVTKILKQNT

SEQ ID NO: 5046 - protein, 482 aa, Oryza sativa
MEERLADVEGSFACNSRGEDDFRSCCGDEDEWEDTEESFTAGVAKGELDESSVRLFFKGVSSPEAEGKKLSGIGVVMERSPGVPMLQVQKKLDFYVDELVADHLALMDGLLIAEAEILEDQLLVALGHRILELVEKLEDFDIILLPSFELERPLQLAKEAIGIMYLSPYEVGTCSICCEEKRGAQMIKVGCAHTFCYSCLTSYTQEKLQTNKVPIRCPQLRCKYHISASEFSCYDSLERAFAEAGTSDMERFYCPFPNCSVLLDLSQHFSRASTSSQSDLNCVECPECHRDICINCGVPWHVMMGCDEYQSLPVDERDAGDLSLHRLAQNNRWRRCQRCRRMIELTQGCFHMNCWCGHEFCYSCGAEYTNGIQTCQCVFWDEESIEAASAAHSTQASEIWAWDTFDCMPTAIEGYSEQERAQLALIQRFLSGGFNLGEPPSQSPPRCADSYIIDTMKDLHQLPWLERFVSVISDSYNEDYIQ

SEQ ID NO: 5047 - protein, 499 aa, Streptomyces avermitilis MA-4680
MTPGTPGNPAAPVTPGASDAQRLFIGGEWVAPDGGHYEVIDPATEAVVGWAPEASRDQVHAAAAAAREAFAAWSRTPAEERAAVLGRAAEVMRRNLVPYAELAQAESGATTGTARGMQVGVGAARFRRYARVEPAEEPIAPQINEAGPFGRAAVMGALAVRQPVGVVTCITSYNNPWANPAGKIAPALAMGNTVVVKPAPQDPLSVYRMAEALQAAGVPPGVVNVVSGSGAQAGEAAVDCPDVDMVSFTGSTAVGQRIAEVCGRGMKRQLMELGGKGAALVFEDADLASAVSGIGTTFSFYSGQICTAPTRVLAQRGVYDRVVDQLAAYARRLPVGDPRAPGTVVGPVISAAHRDRVESYVELGRKEGARVVTGGERPPCATGFYVAPTLLADCTTDMRVVREEIFGPVVAVLPFDDEEEGIELANSSDYGLIDYVWSADVARAFRVARRLRAGGVGVNTVGRNMEAPFGGFKRSGVGRDVGSYALHAYSELQAIVWPG

SEQ ID NO: 5048 - protein, 310 aa, Ralstonia solanacearum
INGFGRIGRMVFRAAVANFKDIEVVAINDLLEPDYLVYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSEGALKGVLGYTEDKVVATDFRGDARTSIFDAEAGIALDGTFIKVVSWYDNE

SEQ ID NO: 5049 - protein, 323 aa, Sphingomonas paucimobilis
MNGPDLQRSLRLFERMLLIRRMEERLGDLGKAGELPGNVHLYIGQEAVATGVCAHLDDSDWVASTHRGHGHFLAKGGDPRAMAAELMGKETGICHGKGGSMHVADVSKGILGANGIVGGGVGLAVGAALGAQLDGEGRVAVVFFGDGASSQGVISEALNIAALWKLPLLLVCENNGFSQFSPYETVNAGDIWRRAEPFGMPGALVDGNDVHAVWRVVGEAVARARSGEGATLIEARTYRWRTHVESEESFLAAPYRTQEEVESWKQRDPISRLEEFLVSEDLEKDVAAIRARVEGVTESAITDALNDPLPPVSRAFEDMFANG

SEQ ID NO: 5050 - protein, 491 aa, Synechococcus sp. PCC 7942
MPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGPPGALTGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSLKKSYKAWILANTGWKPTLALPRMHLTP

SEQ ID NO: 5051 - protein, 332 aa, Bacillus cereus ATCC 14579
MLKTTESKGNEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAAEAVERARNGDGPTIIECMTYRNYGHFEGEAQTYKTSEEKEEHLNEKDAIVNFRKHLIHEALLTESELVDMEKPVDEAVQRSIEFSENSPYPDDEELLKDVYVSYK

SEQ ID NO: 5052 - protein, 89 aa, Oryza sativa
SRVAYRTKMFYNDVIFYSLEFSVSRIALVKPDKARGVEDVLLRAAQSGGISEKVSEERLISLLEQINTHTSKQTKVTIQRRRSVLDDDD

SEQ ID NO: 5053 - protein, 511 aa, Liquidambar styraciflua
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 5054 - protein, 318 aa, Musa acuminata
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENWKLEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 5055 - protein, 802 aa, Glycine max
MATPILYNVPSLGHHPRSHLLFPSLPQMSSTFSPLLNLIAVFLLLFLVRHTCEARDPFACDPKNGATENMPFCKASLAIPERVKDLVGRLTLQEKVRLLVNNAAAVPRLGMKGYEWWSEALHGVSNVGPGVKFNAQFPGATSFPQVITTAASFNASLWEAIGQVVSDEARAMYNGGTAGLTYWSPNVNIFRDPRWGRGQETPGEDPVLAGTYAASYVRGLQGTDGNRLKVAASCKHFTAYDLDNWNGVDRFHFNAQVSKQDIEETFDVPFRMCVKEGKVASVMCSYNQVNGVPTCADPILLKRTVRGQWGLNGYIVSDCDSVGVFYDNQHYTPTPEEAAADAIKAGLDLDCGPFLAVHTQNAVKKGLLSEADVNGALVNTLTVQMRLGMFDGEPSAHPYGHLGPKDVCKPAHQELALEAARQGIVLLKNTGPVLPLSSQLHRTVAVIGPNSKATITMIGNYAGVACGYTNPLQGIGRYARTVHQLGCQNVACKNDKLFGPAINAARQADATVLVMGLDQSIEAETVDRTGLLLPGRQPDLVSKVAAASKGPTILVLMSGGPVDITFAKNNPRIVGILWAGYPGQAGGAAIADILFGTANPGGKLPVTWYPEEYLTKLPMTNMAMRATKSAGYPGRTYRFYNGPVVYPFGHGLTYTHFVHTLASAPTVVSVPLNGHRRANVTNISNRAIRVTHARCDKLSISLEVDIKNVGSRDGTHTLLVFSAPPAGFGHWALEKQLVAFEKIHVPAKGLQRVGVNIHVCKLLSVVDKSGIRRIPLGEHSFNIGDVKHSVSLQAAALGIIKS

SEQ ID NO: 5056 - protein, 54 aa, Escherichia coli
MSQPIFNDKQFQEALSRQWQRYGLNSAAEMTPRQWWLAVSEALAEMLRAQPFAK

SEQ ID NO: 5057 - protein, 372 aa, Schizosaccharomyces pombe
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 5058 - protein, 181 aa, Zea mays
  unsure (1)..(181): unsure at all Xaa locations
LNHNGSYQVPSVQQPRHDGDDDERGRSCVERQRGADCGASRSHPAGGLPPDREGGALRCAHHNNHYDGAMNFMHRDEEVDYYPSRHAPLRXAAPPTPCRQPVAGRREKATIRKPNDFKQPGERYRSWDADRQDRFVRRFADSLGHPKVSQELRSIWIDLLAKCDASLGMKIATRLNMKANM

SEQ ID NO: 5059 - protein, 483 aa, Arabidopsis thaliana
MPEDSTAIDYVMEKASGPHFSGLRLDGLLSSPSKSSVSSPSHFRLSNSSFSATDDPAAPHQPFVIGVTGGTASGKTTVCDMIIQQLHDHRIVLVNQDSFYRGLTSEELEHVQEYNFDHPDAFDTEQLLHCVDILKSGQPYQIPIYDFKTHQRKVDAFRQVNACDVIILEGILVFHDSRVRDLMNMKIFVDTDADVRLARRIRRDTVERGRDVDSVLEQYAKFVKPAFDDFVLPSKKYADVIIPRGGDNHVAVDLIVQHIHTKLGQHDLCKIYPNVFVIETTFQIRGMHTLIREKDISKHDFVFYSDRLIRLVVEHGLGHLPFTEKQVVTPTGSVYSGVDFCKKLCGVSVIRSGESMENALRACCKGIKIGKILIHRDGDNGMQLIYEKLPSDISERHVLLLDPVLGTGNSANQAIELLIQKGVPEAHIIFLNLISAPEGIHCVCKRFPKLKIVTSEIDQCLNEEFRVIPGLGEFGDRYFGTDE

SEQ ID NO: 5060 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 5061 - protein, 355 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHIKKKENQNAVDDGDVVDTDMVDDLLAFYSEEAKLVSEAADLQNSIKLTRDNIKAIIMDVMFGGTETVASAIEWALTELLRSPDDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 5062 - protein, 396 aa, Zea mays
MAAGDLEVLTALDTAKTQWYHFTAIVVAGMGFFTDAYDLFCISLVAIVVSASFKARFPAPAYAVDPAGSTPPQADFVWRIILMLGAMPAALTYYWRTKMPETARYTALVAKNAKQAAADMSKVLQVEISAGAAEEDAVAATATAPAPASASASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGETEPGAAEP

SEQ ID NO: 5063 - protein, 151 aa, Glycine max
  unsure (1)..(151): unsure at all Xaa locations
LKSMAGFPTTKTNNDITCIVSNRGKLQCMHVWPPLGKKKAETLCYLTDLDDAQLANEVQYLLRKGWIPCWELESEHGCMYREHNMSPGYYYGLYXTMWKLTMLGCTDAYHVLNELQEANTAYPSGYIRIIGFDSVRQLLCISYIIYKRSRF

SEQ ID NO: 5064 - protein, 456 aa, Cladodonta lyalli
KNDRYESGVIPYAKMGYWDPEYVIKETDILALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMEEMYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPELKLNLPLGIFFRQDWASLRKVTPVASGGIHCGQMHQLLDYLGNDVVLQFGGGTIGHPDGIQAGATANRVALESMVIARNEGRPFVEEGPQILRDAAKTCGPLQTALDLWKD

SEQ ID NO: 5065 - protein, 425 aa, Zea mays
MAARAADENRRPAAGKPAPGVRDMASRRALTDIKNLVGAAPYPCAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPLAATEYVKELYTFYRENEAKSCVNPDYMSSQQDINSKMRAILIDWLIEVHYKFELMDETLFLTVNVIDRFLEKEVVPRKKLQLVGITALLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTGDQLLECSRMMVDFHQKAGTGKLTGVHRKYSTYKFGCAAKILPAQFMLESGGTAPPPSGAI

SEQ ID NO: 5066 - protein, 812 aa, Pseudomonas aeruginosa UCBPP-PA14
MPDSQDQTPSTVQTLKASILAKLRYSVGRDPSTACPHDWFEAVALAVRDHIIDHWEEATPQGEAPARKRVYYLSLEFLIGRLLLDNLGNLGLLEETRQALAELGVDLQRIVALEPDAALGNGGLGRLAACFMESMASLDIPAHGYGIRYEHGLFRQVLTDGWQQEQTETWLDFGNPWEFERPEVSYYIDFGGSVQVDSEHSGRAIWRPDERIRAIAYDTPIVGWRRASVNTLRLWRARAEEDLQLDRFNAGDHIGAVVDVVKAESISRVLYPADSTEAGQELRLRQEYFFVSASLQDLLDRHLRHHHDLRSLPEQVAIQLNDTHPAIAVAELMRQLVDVHQLAWPDAWALSVATLSYTNHTLLPEALESWPVALMERLLPRHMQIIYLINAFHIDALRAQDIHDFDLLRSVSLIEEGHGRRVRMGNLAFLGSHQINGVSALHTELMRETVFHDLHRLYPQRISNKTNGVSFRRWLFQANPGLTELLVETLGADLLDTPERRLPDLEEHVEDARLRARFAEQRRQNKTALARLVLDSLGVAIEPEALFDVHIKRIHEYKRQLLNLLHTVALYQEIRNDPTADRVPRVKIFAGKAAASYHQAKLIIKLANDIARTINDDPTVRGLLKLVFLPNYNVSLAEAIIPAADLSEQISTAGLEASGTSNMKFALNGALTIGTLDGANVEMSQRIGLEHMFIFGLSAQQVEQRRQAGELEMGGVIAASPRLEEALEAIRSGLFSADDRSRYEGLVDGLVHDDRFMLCADFEAYWHAQCRVEEVWREPDRWWRSALLNVARIGWFSADRTISEYARDIWKL

SEQ ID NO: 5067 - protein, 214 aa, Nostoc punctiforme
MTSYATSSAKAEMSELRRLKGLLPPELQSWVTVEGTTEVNPPLVRCEEIGKDQVEIQIDLVKWDALAMDQRNLLFWHEVARVQNDTIPKDGWEMAALAIGLGGAVGELWVQDGLLLVLALSLCGVSGWRLYQKNNGEKQLKELLNADEKAIALATRFGYSLPNAYKSLGSALKTLIDNTPSKRQRSRYEARLSALKRSANKAKAKSKTPDEGGL

SEQ ID NO: 5068 - protein, 362 aa, Photobacterium profundum
MKSLASKLAPKAVEKLIPYQSARRIGGSGHLWLNANELESSCQYGDESKGRNDVYNRYPDFLPHDIAVEYQAYCEQASGALGCETVAVRGADEAIDLLIRTFCQPGNDQIMVCPPTYGMYEFCADAFSVNTLAVPLLDNFQLDVAAIKAQLADTSLLFLCSPNNPTSNTIHHHDIVELLEASKASTLIVVDEAYIEFAPETSVLHLMVQYPHLIVIRTLSKAFGLASIRCGFLMADESVMSYVARLIAPYPIADPTAEIALKALAPEGLKSMRSQTDELITTREWFISELQALQIVDVVYASATNFVLIHFNTSNSIYDYLLTKGIVTRNQAHESMLEHCVRISIGSKNSMLETLNALQQYQ

SEQ ID NO: 5069 - protein, 336 aa, Fusobacterium nucleatum subsp. vincentii ATCC 49256
MEDKVLIINTGGTIGMVGKPLRPAYNWFEITKGYSMLEKFPTDYFQFEKLIDSSDVTTDFWIKLVEVIEKNYDKYLGFVILHGTDTMAYTGSMLSFLLKNLAKPIILTGAQAPMVNPRSDGLQNLINSIYIAGHKLFDIPLIPEVCICFRDSLLRANRSKKTDSNNYYGFSSPNYNPLAEIATEIKVISDRILKVPTEKFYVEKNIDANVLLLELFPGLNSKYISDFIESNKNIKALILKTYGSGNTPTSEDFIETLKSISKKDIPILDITQCISGSVKMPLYESTDKLSKLGIINGSDITSEAGLTKMMYLLGKKLNLEEIKNAFTISICGEQTV

SEQ ID NO: 5070 - protein, 398 aa, GIBBERELLA ZEAE PH-1
MAGSNDLEANGASPRYEGVDSGFIEKAPTQRSASRTHASVYILTWIFFSNATILFNKWLIDTAGFRYPIILTTWHLVFATIATQLLARTTTLLDSRHALPLSRRLYVRTILPIGVLYSASLVFSNIVYLYLSVSFIQMLKATGPVFTLIASWAWGVAQPDAKTFGNIMIIVVGVAIASFGEIEFSVWGFIFQMCGTIAEAVRVVMIQVMLSAEGLRMDPLVGLYYYAPVCTLMNLVVVLFSEGPRFKWEDAATAGYGMLFANAFLAFILNVISVVLIGKTSGLVMTLSGILKSILLVAASVVIWSTHISLLQTLGYSIALMGLVLYSVGYEQLLDAWDGLVAWGTGVNREGEMSPALRKAIMVGCLGFITVIITGALWHYHGLSGTQVARATTSWLGH

SEQ ID NO: 5071 - protein, 368 aa, Bradyrhizobium japonicum USDA 110
MTQRLPPSLTPLDTALAALLRDVEPITPVALPLTEAIGCIAADAPLLAAYPPHDIAGMDGWALRANDLVGASAYSPSPLATAPAWVDAGDAMPAGCDCVLDADAVEMSGPLAQVLAEGVPGQGVRRAGSDIAVRTLAGTEGYPVGPAALMLAGVAAVDRLSVRRPRLRIVNVPDTTTTAHMIAGIARVAGLDVRAFEAAARDGASIADALDASSCDLLLIVGGSGVGRRDAAVAALARRGDVIAHGIALQPGRTAAVGRLEKVPVVALPGSPDHALAAWLALVLPLVDRLSARQLRRHVTRPLARKIASSVGIAEIALLAEDHHAWMPLAVGEWPFQAIARADAWLIIPASHEGFAAGACVDAYLMRE

SEQ ID NO: 5072 - protein, 484 aa, Zea mays
LACLQDALLGKRCPDLVSGWPRRLSVARDVATALHYLHSVVQPPVIHGDVKPSNVLLDADLRARLSDFGLARIRSEEEDELGSGAIGADADGNANPSGGCDEDMSVAGESTTAVVVNGEDNAAKSPEDDEALTTASPAAEAVSTSGCDKTSVGSGCNARSCNGGGAGGSGTGSDWWWRQDNGGGGSGGGGSGGVKDYVMEWIRSEIKKERPKNDWIAGPSAVTPVAPTERKKPKRRAREWWREEYAEELTKKQKRRALAKSKSDAGAMSGLQWWERDCDFEEKGHSRWTMMKSWSRRSSNGNGNSNSSISWWVDGVRRSSRDWASGEFVPKSGGAVSSTPSMRGTVCYVAPEYGGGGPLSEKCDIYSFGVLLLVLISGRRPLQMTTSPMSEFEKASLISWARHLAQVGRLLDLVDPALQDVDRDQALLCITVALLCIQRSPARRPSSAEVLDMLAGEGEPPPLPIEFSPSPPGGFPFKSRRKGR

SEQ ID NO: 5073 - protein, 358 aa, Burkholderia fungorum
MAAPGASLTIAAMNTSIPSSTTSSDEGATLLPRIAVLATGGTIAGAAADATNTSGYQAGVVGVEQLLAVVPALSAVARVAPEQIASIDSKDMALPLWTTLAQRINALLADDDIDGVVVTHGTDTLEETAYLLHLTIKSDKPVVLTAAMRPASALSADGPLNLLNAVTVAAHVASRGQGVLVAFNNRIHSARDVVKTSTYAVDAFHSPEIGALGWVQDGRVEFQRSVVRPHTLATEFVIGAKWPHVEIVVSYAGVSRIAVDALVAAGVRGIVVAGTGNGSIHASVQQALADAASQGVAVVRASRVGSGHVMRNGAAADDALGFVSAGSLNPYKARVLLMLALAAGAAGPMVLQKIFDTY

SEQ ID NO: 5074 - protein, 250 aa, Desulfovibrio desulfuricans G20
MKKLMAANWKMYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 5075 - protein, 305 aa, Thermus caldophilus
MLVTGLEILRKARAEGYGVGAFNTNNMEFTQAILEAAEEMKSPVILALSEGAMKYGGRALTRMVVALAQEARVPVAVHLDHGSSYESVLKALREGFTSVMIDKSHEDFETNVRETKRVVEAAHAVGVTVEAELGRLAGIEEHVAVDEKDALLTNPEEARIFMERTGADYLAVAIGTSHGAYKGKGRPFIDHPRLARIAKLVPAPLVLHGASAVPQELVERFRAAGGEIGEASGIHPEDIKKAISLGIAKINTDTDLRLAFTALVRETLGKNPKEFDPRKYLGPAREAVKEVVKSRMELFGSVGRA

SEQ ID NO: 5076 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 5077 - protein, 459 aa, Calcidiscus leptoporus
DPEYSIKETDLLALFRCTPQPGVDPVEAAAALAGESSTATWTVVWTDLLTACDLYRAKAYRVDPVPSAADTYFCYVAYDIDLFEEGSLANLTASIIGNIFGFKAVKSLRLEDMRMPYALLKTYQGPACGLIVERERLDKFGRPLLGATVKPKLGLSGKNYGRVVFEGLKGGLDFLKDDENINSQPFMRYRERFLYSMEGVNHAAATTGEVKGHYLNATAATMEDMYERAEFCKELGSVIVMIDLVIGYTAIQSMAKWSRKYDMILHLHRAGNSTYSRQKNHGMNFRVICKWMRMSGVDHIHAGTVVGKLEGDPLMIKGFYNTLLDFKTDVNLPQGLFFAQDWASLRKCVPVASGGIHCGQMHQLINYLGDDVVLQFGGGTIGHPDGIQAGATANRVALECMVIARNEGRDYIAEGPQILRDAAKTCGPLQTALDLWKDITFNYASTDTADFVDTATANV

SEQ ID NO: 5078 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGAMKGVLGYTEDDVVSTDFNGEVCTSVFDAKAGIALNDNFVKLVSWYDN

SEQ ID NO: 5079 - protein, 411 aa, Zea mays
  unsure (1)..(411): unsure at all Xaa locations
LVSCHLIRTLIDQITVHAPGPQWACTTSVDFSLAQLIQVIILLSTGGANGGGYLASKYVVLAIYTAILVVHGLINSLHIQWLSWFGQLGALWNVAGVFVLVILVPSVAKERASAEFVFTHLNTDNGMGIHSKAYILAVGLLMSQYSSIGYDTSAHMTEETKKADWSGPMGIVYSVALSSVFGWVYLLALTSVVTDIPYLLDTSNGAXGGYAIAQALYDTFRRRYGTGAXGGIACLVIIAVAVFLCGTACVTSNSRMGYAFSRDGAMPFSHLWYRVNKQEVPFNVVWLSVSVAFVMALTSLGSQVAFQAMVSIATLGLYIAYALPIFFRVTTARKSFVPGPFHLGRCGIAVGSVAVLWVALVTVLFCLPVAYPVAKDTFNYTPVAVGGVLVLSLVAWVLHARFWFRGPITNV

SEQ ID NO: 5080 - protein, 333 aa, Yersinia pestis KIM
MSPVSRSYNLIHYRYAPDAPEGKKRMTKKADYIWFNGEMVPWAEAKVHVMSHALHYGTSVFEGVRCYESHKGPVVFRHREHMQRLHDSAKIYRMPVSQSVDELMEACRATLRKNNLTSAYIRPLVFIGDVGMGVNPPEGYNTDVIIAAFPWGAYLGAEALEQGIDAMVSSWNRVAPNTIPTAAKAGGNYLSSLLVGSEARRHGYQEGIALDVHGYLSEGAGENLFEVKDGILFTPPFTSSALPGITRDAIIKLAKDMGLEVREQVLSRESLYLADEVFMSGTAAEITPVRSVDGIQVGIGKRGPVTAKIQQAFFGLFTGETEDKWGWLDQVNP

SEQ ID NO: 5081 - protein, 400 aa, Marchantia polymorpha
MSVASVSASVAKASQVSGKDFSGLKSTSVATFGKRSDDLLTRVAAQSAVAVSGAQKRAVVEAKVKVAINGFGRIGRNFIRCWHGRKDSPLEVVVINDTGGVKQASHLLKYDSMLGIFDAYVKAVGDDAISVDGKIIKIVSDRNPLNLPWGEMGVDLVIEGTGVFVDKEGAGKHLQAGAKKVLITAPGKGPIPTYVIGVNEELYDPSEQIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFREAANGDMKGILAVCDEPLVSVDFRCTDVSSTVDSSLTMVMGDDMVKVVAWYDNEWGYSQRVVDLANLVAEKWTGA

SEQ ID NO: 5082 - protein, 276 aa, Burkholderia fungorum
MNPIELSFEFFPPKTQEGVDKLRATRAQLATLKPKFVSVTFGAGGSTQQGTLDTVVDMAKEGLEAAPHVSCIGSSKESLRAILNEYRAHGIRHIVALRGDLPSGMGEVGELRYASELVSFIRAEFGDWFCIEVAGYPEYHPQSRSPRQDLENFARKVKAGANSAITQYFFNADAYFRFVDDARKLGVDVPIVPGIMPITNFSQLMRFSEMCGAEVPRWIARRLESFGDDRESIRAFGLDVVTDLCRRLIDAKVPGLHFYTLNGAAATKAICERLNV

SEQ ID NO: 5083 - protein, 630 aa, Eubacterium acidaminophilum
MEARKKYISNTDFEDAKRIYENRVGYNLKLQKERTDVIASIGRVTCKPVYALESSPCYNASAMDGIAVNSRSTHGASETNPIELQENADFSYVNTGNPINEPYDSVIMIEDVMELGEGKVNIIAPSHPWQHVRPIGEDMVKGEMIIPSGHIVRPVDIGALLAGGLESIDVYKKPLLGIIPTGSELVDSLEELREGKVIESNSRVFEARASELGAQALRYEPCPDEFELLKARIKQAVSECDIVVINAGSSAGTRDYTANLIEELGEVVIHGIAIKPGKPTILGIIDGKPVIGLPGYPVSTYVAFESFVKPILLSMQGLEECGEESVEAVVTMRIPSSLKHKELVRVNVGHVSGRFVATPLTRGAGVTMSLVKADGLLEIQRSSEGLDAGTLASVKLLKPTQELRKTLVSIGSHDIIMDEISDMMKLTSGHVGSMGGIMSMMRRECHIAPIHLLDEESGEYNLPYIKKFFGNGSMALIKGVKRLQGLMLQCGNPKDINDFQDLAREDVVFVNRQRGAGTRILLDYNLKKLGIDPGAVNGYERDMNTHMAVAIAVKTGSADAGLGVFSAAKALNLEFIPLGYEEYDFLVNADYLEDDRVKRFIGILESEEFAARLDNLGGYKLEEAGKVIRV

SEQ ID NO: 5084 - protein, 67 aa, Zea mays
  unsure (1)..(67): unsure at all Xaa locations
MFIESFRVXESPHVRYGPTEIESEYRDDTTDLVHDGKDGASRWVDRPKSVKYNFRTRTGVPKLTLML

SEQ ID NO: 5085 - protein, 337 aa, Staphylococcus aureus subsp. aureus MW2
MIYIDKNESPVTPLDEKTMTSIISATPYNLYPDAAYEQFKEAYAKFYGLLPEQIIAGNGSDELIQKLMLIMPKGPALTLNPDFFMYQAYAAQVNREIAFVDAGSDLTFDLETILTKIDEVQPSFFIMSNPHNPSGKQFDTAFLTAIADKMKALNGYFVIDEAYLDYGMAYDVEMAPHILRMRTLSKAFGIAGLRLGVLISTAGTIQRIQKIEHPYPLNVFTLNIATYIFRHREETRVFLTMQRQLAEQLKQIFDTHVADKMSVFPSNANFVLTKGSAAQQLGQYVYEQGFKPRFYGEPVMKGYVRYSIATAPQLNQLEEIVKEWSAKYDLSKTTKHS

SEQ ID NO: 5086 - protein, 131 aa, Triticum aestivum
  unsure (1)..(131): unsure at all Xaa locations
WIGQKVQIVGDDXLVTNPTRVAKAXINEKTCNALLLKVNQIGSVTESIEAVRMSKRAGWGVMASHRSGETEDTFIPLLAVGPSTGQIKTGAPCRSERLAKYTQLLRXIEEELGDAAVYAGXAKFRAPVEPY

SEQ ID NO: 5087 - protein, 196 aa, Cichorium intybus x Cichorium endivia
GHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKREVTAEEARVYAEENGLFFMETSAKTAANVNDVFHEIAKRLPRAQPTQNPAGMVLVDRPAEGARAASCCS

SEQ ID NO: 5088 - protein, 498 aa, Lycopersicon esculentum
MAKKNFVLHYNLLLISLLAFLFLLTEGAPQSALVTQLPGFNGTFNSKHYAGYVNIDESHGKNLYYYFVESERNPSKDPVVLWLNGGPGCSSFDGFVYEHGPFNFDFGKPSGSLPSLHNNPYSWSKVSNIIYLDSPVGVGLSYSGNKSDYNTGDLKTASDSHSFLLKWFEIYPEFLKNPFYISGESYAGIYVPTLASEVIKGIDAGVRPAINFMGYMVGNGVADDIIDGNAIVPFQHGMGLISDDLYEEAVVACHGNFYEPVDSNCSEKLNKIDQVVYDLNVYDILEPCYHSKKPSVITTGNSRLPMSFRKLGETERPLPVRKRMFGRAWPYKAPVRAGHVPTWPEILNSVEVPCTDDRVATLWLNNADVRKAIHAEPATVIGPWELCTDKIDLDHDSGSMIPYHKNLTARGYRAIIFSGDHDMCVPFTGSAVWTKSLGYPIVDEWRPWYVNDQVAGFIQGYANNLIFMTIKGAGHTVPEYKPREALAFYSRWLEGKKI

SEQ ID NO: 5089 - protein, 764 aa, Pseudomonas aeruginosa PAO1
MNRLCVLGLLIGLSGSPALAAGQGESGNPPATDKERFIASLMARMSNAEKIGQLRLVSVGADHPKEALMADIRAGKVGAIFNTVTRPDIRAMQDQVRHSRLKIPLFHAYDVAHGHRTIFPISLGLAASWDPEVVARSARISALEASADGLDMSFSPMVDITRDARWGRVSEGFGEDTYLTSLLSGVMVRAYQGSNLAAPDSIMAAVKHFALYGAAEGGRDYNTVDMSLPRMFQDYLPPYKAAVDAGAGAVMVSLNTINGVPATANRWLLTDLLRQQWGFKGLTISDHGAVKELIKHGLAGNERDATRLAIQAGVDMNMNDDLYSTWLPKLLAAGEIDQADIDRACRDVLAAKYDLGLFADPYRRLGKPDDPPFDTNAESRLHRQAAREVAREGLVLLKNRDGLLPLKKQGRIAVIGPLAKSQRDVIGSWSAAGVPRQAVTVYQGLANAVGERATLLYAKGANVSGDQAILDYLNSYNPEVEVDPRSAEAMLEEALRTARDADLVVAVVGESQGMAHEASSRTDLRIPASQRRLLKALKATGKPLVLVLMNGRPLSLGWEQENADAILETWFSGTEGGNAIADVLFGEHNPSGKLTMSFPRSVGQVPVYYNHLNTGRPMDHDNPGKYTSRYFDEANGPLYPFGYGLSYTEFSLSPLRLSSERLARGATLEARVTLSNSGKRAGATVVQLYLQDPVASLSRPVKELRGFRKVMLEPGESREIVFRLGEADLKFYDSQLRHTAEPGEFKVFVGLDSAQTESRSFTLL

SEQ ID NO: 5090 - protein, 770 aa, Aspergillus niger
MADSGLVDHSPHHPTKAAQLSTASNVILIDNYDSFTWNVYQYLVLEGATVNVFRNDQITLEELIAKKPTQLVISPGPGHPETDAGISSAAIQYFSGKIPIFGVCMGQQCIITCFGGKVDVTGEILHGKTSPLKHDGKGAYEGLPGSLAVTRYHSLAGTHATIPDCLEVSSSVQLADDSNKDVIMGVRHKKLAVEGVQFHPESILTEYGRIMFRNFLKLTAGTWEGNGKHFGEQSSTTKATVPSNPPPKTDKKLSILERIYDHRRAAVAVQKTIPSQRPADLQAAYDLNLAPPQIPFPARLRQSPYPLSLMAEIKRASPSKGMIAENACAPAQARQYAKAGASVISVLTEPEWFKGSIDDLRAVRQSLEGMTNRPAILRKEFVFDEYQILEARLAGADTVLLIVKMLSVELLTRLYHYSRSLGMEPLVEVNTPEEMKIAVDLGAEVIGVNNRDLTSFEVDLGTTSRLMDQVPSSTIVCALSGISGPKDVEAYKKEGVKAILVGEALMRAADTATFIAELLGGSSQTVSSESRRSPLVKICGTRSEEAARAAIEAGADLIGIIMVQGRTGCVPDDVALPISQVVRSTPKPASQALHTSQEPPAATSVEYFDHSAKILRHPSRALLVGVFQNQPLDYILSQQQKLGLDVVQLHGSEPLEWAKLIPVPVIRKFGLDEPAIARRAYHSLPLLDSGVGGTGELLDQSRVQNVLDKDCGLRVILAGGLDPTNVAGIVQKLGESGRKVVGVDVSSGVESDGAQDLNKIRAFVQAVRGL

SEQ ID NO: 5091 - protein, 216 aa, Glycine max
MARRAEEEYDYLFKVVLIGDSGVGKSNLLSRFTRNEFCLESKSTIGVEFATRTLQVEGRTVKAQIWDTAGQERYRAITSAYYRGALGALLVYDVTKPTTFENVSRWLKELRDHADANIVIMLIGNKTDLKHLRAVATEDAQGYSEKEGLSFIETSALEATNVEKAFQTILAEIYRIISKKSLSSNEPASANIKEGMTITVGGPQSNTSKPSCCTSS

SEQ ID NO: 5092 - protein, 185 aa, Triticum aestivum
  unsure (1)..(185): unsure at all Xaa locations
LTSRSACVRVHGVQFRPSSSFDTKTTTTNAGQPVWNDNEALTVGPRGPILLEDYHLLEKIAHFXAREAHPGSRVVHARGGLRQGLLPSCTHDVTGLTXADFLRAPGXARNPVIVRFSNVIHERGSPETXRRPRGFAVKFYTARELGLLGNNFPXLIRDGIKFPTSSSLKPTNPSEDTGSQFSPQR

SEQ ID NO: 5093 - protein, 166 aa, Schizosaccharomyces pombe
MSDQDALDTQEKELLEMKERVAEMEAEAAKLRAMQEQLDNETEALRNDKESIDAQSVYVGNVDYSVTPEELQSHFASCGSVNRVTILCDKFTGHPKGFAYIEFSEPSLVPNALLLNGSMLHERPLKVTPKRTNVPGMSRGRGRGRGRGRGRGRGGYRGRARGFAPY

SEQ ID NO: 5094 - protein, 825 aa, Hordeum vulgare subsp. vulgare
MAFSPRSPWSRSKKPDIYSTVVVHDDEDDAHGGGAARAEDDDDDDPSALPPLLQRLPKDFGGASFDDDDDPYSSDLDDASLSATVVIKRGAPASTSSSSRSPFLDLRRSSPRAAEADPYSTFVVHGTARSGGASSPRESVSGTFIRHSGGPPSPRESVSGTFIRHTRGSSSPRESYSGTFIHHTSGASSPRDPASGAGAGFGSSFMTPSTGQAEEDRQPSLLMQQQQSRRQASMSSVPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPAAIEMLKHKFIEKCNTGASKMLAKIKEAKIIRETAVQNQLPDSDDAMDATVRINEDYGETVPTNSQSTHETKNDGSGGDFGTMIVHPEDGDEAVESSIFPRAEFIPGLGSINSFTHDPKRAELISKFWAENTADSDATKGRDLDGLPDTQEPKAMPRSIGTFKHHKGVEGTVLRHDNTASPGVASTMTKLSSSPSRKAFSVQDKLWSIYAAGNTVPIPFLKAIDISPLALVSDSVAGNGPAGSSTTDALEAVRELFSGDGQAKKGRKGQNEVPLPPGVHDRLTTSPTLMNLAQALAYHKTCYEDMPLQDSQATEEQQTIQNLCDTLRTILRL

SEQ ID NO: 5095 - protein, 379 aa, Cercospora zeae-maydis
MATEQIPDKGLAGVCVNEGPDFKVEVQEVDIPEPSKQNCWTISVNSSLTERWPESGELLIRLNCTGLCMSDIHFMVNDWAVPPMSQFGTKCAGHEGAGVVVKLGPNVSGWEVGDRAGIKPLWDVCHNCEHCWNGRENYCQHGVYTGLVAEGTYRQYLTSPAIYTSRIPEGVPDEVAGPIMCSASTMHRALVDSGLKAGDFVVFPGGGGGVGIQGVQLAKAMGMRPIVIDSGEAKSKLSKELGAEEFIDFKEHEDVAARVKEVAGGIGAHGVLVTAYQAYKDSFSYLGNRIGGRIMCIALPPAGTVNMGTDPNFIVFKNVRVIGTLVGTMQDTAAALEYARRGLLKGIAKVQGVSRFDKSVQALQRGKVAGRIVIDFNKK

SEQ ID NO: 5096 - protein, 460 aa, Eucheuma arnoldii
  unsure (1)..(460): unsure at all Xaa locations
RAPQYVVKXTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPILGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 5097 - protein, 584 aa, Prochlorococcus marinus subsp. marinus str. CCMP1375
MTLSSSPFGIGDSTKKEQNQILGADALMESLKNHGVDTIFGYPGGAILPIYDAVYKAEKAGWVKHILVRHEQGGAHAADGYARSTGKVGVCFGTSGPGATNLVTGIATAQMDSVPLVVITGQVPRPAIGTDAFQETDIFGITLPIVKHSWVVRDPSEIASVIAQAFFIASSGRPGPVLVDIPKDVGQELFDYQPVQPGSLIPAGFTPPQKPDPVAISKALDLIERAKKPLLYVGGGVISASAHDTLFAIAKRYHLPVTTTLMGKGAFDERESLSVGMLGMHGTAYANFAVTECDLLVAIGARFDDRVTGRLDSFAANAKVVHFEVDPAEINKNRVADVAVLGDLAISLSDLHELSKRRTVKPNTQEWLAQIEEWKIKYPLLIPSKEGEIYPQEVLIEIRDLAPDAYITTDVGQHQMWAAQYLRNSPRHWISSAGLGTMGFGVPAALGVQVALPKQQVICIAGDASILMNIQELGTISQYQLNTKIIIINNHWQGMVRQWQQSFYDERYSATNMLNGEPNFVALANAFGVGGVIIKERNSLKEKLKEALNSEGPMLIDVHVRRDENCYPMVPPGKSNAEMVGLPD

SEQ ID NO: 5098 - protein, 145 aa, Zea mays
  unsure (1)..(145): unsure at all Xaa locations
LLCGYMRRDGHEGDVSCQGRDDTVMFGPDDDGVKIPTQVETLVKGTAMVAEPEYKASPDLDYLQELLAIQQQGPRAIGFFGTRNMGFMHQQLIEILSYAMVITKNHIFTSGASGTNAAVIRGALRAEKPELLTVILPQGLXKQPP

SEQ ID NO: 5099 - protein, 167 aa, Triticum aestivum
  unsure (1)..(167): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKXNXDXYVGIIGSQHRKVNASLHNGQDPEG

SEQ ID NO: 5100 - protein, 643 aa, Arabidopsis thaliana
MALDSSVALSPRRRHGLLRDQVQLIKRKDSGRYEIVPIEDPLSFEKGFYAVIRACQLLAQKNDGLILVGLAGPSGAGKTIFTEKILNFMPSIAIINMDNYNDGTRVIDGNFDDPRLTDYDTLLDNIHGLRDGKPVQVPIYDFKSSSRIGYRTLEVPSSRIVILEGIYALSEKLRPLLDLRVSVTGGVHFDLVKRVLRDIQRAGQEPEEIIHQISETVYPMYKAFIEPDLKTAQIKILNKFNPFSGFQNPTYILKSSKAVTPEQMKAALSEDFKERTEETYDIYLLPPGEDPEACQSYLRMRNRDGKYNLMFEEWVTDRPFIISPRITFEVSVRLLGGLMALGYTIATILKRKSHIFDDDKVIVKTDWLEQLNRTYVQVQGKDRTFVKNVADQLGLEGSYVPHTYIEQIQLERLVNDVLALPDDLKTKLSLDDDTVSSPKEALSRASVDSRMKYLHGGVSKSYTNPRHKVLPNLTRLAVNNRMLDARAPASPATLPNQGFITQLSDQISTLNERMDEFTSRIEELNSKIPNRIAPSGSQHNLALPIENGNGSVLSFSASASQLVRESPLMEEVVLVARGQRQIMHQMDTLSNLLREYVGEKTRIERLDSSRTNSTTQNLESSTVPILLGLAIGCVGIFAYSRLK

SEQ ID NO: 5101 - protein, 521 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKSGIPNDIPGRENVREAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 5102 - protein, 399 aa, Zea mays
MARSWLITCRGIAKKIRYTNPGANHHISELVAEARRECPNCSYIIDNSDVAMQWPGLPAGVKFDPSELELLEHLEQKVGLGDSRPHVLIDEFIPTIDNDEGICYSHPENLPGMKTDGSNAHFFHRVSKAYGCGQRKRRRTINCSDHTVSDEHVRWHKTGRSKAIYENGVIKGWKKIMVLYKISQRGRKPDRANWVMHQYHLGEEEDEKDGELVVSKIFCQLPNKSMEISETETAYEEPGAPASVIGPKTPKTVTPQPRHPKNSPCETEQSIFILQDQLLLDGEDEPTMPIVSLADDAMNPAWCAVAEEEQVVGEASRAQSNSDEPLLCREDPNSLNDEALLPWDYPILSQCRSEIFDRNLNGYGLPDLHNVDLGTPPDLQLADFQFGSQESLGSWLDRI

SEQ ID NO: 5103 - protein, 338 aa, Streptococcus pyogenes M1 GAS
MKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 5104 - protein, 318 aa, Oryza sativa (japonica cultivar-group)
MATDGTGVVTVYGSGTNGAALLEPSNHKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPKILAEVSSGLGEAMVGINLSDPKVERFAARSE

SEQ ID NO: 5105 - protein, 179 aa, Glycine max
PPKALEIAINHVRYEDENSRYLCIGSVEKVLCLIARWVEDPNSEAYKLHLARIPDYFWLAEDGLKIQSFGCQMWDAAFAIQAILACNVSEEYGPTLRKAHSFVKASQVRENPSGDFKAMYRHISKGSWTFSMHDHGWQVSDCTAEGLKAALLLSEMATDLVGEEMEAERLYDAVNVILS

SEQ ID NO: 5106 - protein, 321 aa, Schizosaccharomyces pombe
MGSLEVPCIDLSENDTSIVVKELLDACKNWGFVSLKNHGIPLDEIDRTFKLADKFFDIPVEEKQKYLFKGGRLHSGYTGHFGEKLDMEHQSRGDLKESYDLAGFPDPKLENLCPFIAEHMDEFLQFQRHCYKLTLRLLDFFAIGFGIPPDFFSKSHSSEEDVLRLLKYSIPEGVERREDDEDAGAHSDYGSITLLFQRDAAGLEIRPPNFVKDMDWIKVNVQPDVVLVNIADMLQFWTSGKLRSTVHRVRIDPGVKTRQTIAYFVTPDPETPLSPLFEEKTGKDIETVTAGEWIDGRINFTYGYSAPPKGYLGSQNDGIVA

SEQ ID NO: 5107 - protein, 403 aa, Oryza sativa (japonica cultivar-group)
MKDLFGDGIFATDGDMWRHQRKLASYEFSTKVLRDFSSDTFRRNAAKLAEKISCAAANRISINIQDLLMRATMDSIFKVGFGFELNTLSGSDESGIQFSKAFDEANSLVYYRFVDIMWKLKRYLNIGSEAKLKRNIQIIDSFVMKLIHQKREQMKIAADYKTKEDILSRFVLASEQDPGTMDDRYLRDIVLNFLIAGKDTTGNTLTWFFYLLCKNPIVQDKVALEIREFVEWSKEDNTIESFTKRLDEGAISKMHYLQATISETLRLYPAVPVDAKMADEDDVLPNGYRVVKGDGINYMIYAMGRMTYLWGEDAQEFRPERWLVNGVYQQESPFKFVSFNAGPRICLGKEFAHRQMKIMAATLIHFFKFRLEDESKEPIYKTMFTLHIDNGLHLLANPREISP

SEQ ID NO: 5108 - protein, 354 aa, Streptomyces coelicolor A3(2)
MTGARPAPEEHDDTPVRGPVEGAAGPAAGHWWPPRGPVVCVGETMAAMAPAPPDSLDDTESLRLSVAGAESNVAVYLADLGLPVSWLSALGDDAFGRRVRAAVARAGVDVSGVRTDPARPTGLLLKEPGAAGTRVHYYRRGSAASALGPDVLDDERFGGAALLHLTGVTPALSPSCRALVERALRTPPARRTHAVSFDVNHRPALWPPDTAAAVLRDLADRADIAFVGLDEAQDLWGGGLTATDVRRLLSGPRVLVVKDGGRSATAFTGQGACTVPALATEVVEPVGAGDAFAAGFLAGLWRGTDLTRALRLGHITAASALKVVGDHGPLPDEDTVGAMLSLTEQDWCRAPVVS

SEQ ID NO: 5109 - protein, 431 aa, Schizosaccharomyces pombe
DPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 5110 - protein, 181 aa, Oryza sativa
MAGGEPPAPATEAEEGRRAALLREITEEGGFAFVASAEKAACGDLRAAEAAREMAWEQLHSGPWSEVGAAWRDAYALACLHVARLRRLGAAAADRRAALRALDMGLIMGGNLLRADLEAAIARIVADPGGGGDAEAVDEETRSGSIDHWPARTKWKDIQYLKKIAGDRTVPVEVNAFCSLH

SEQ ID NO: 5111 - protein, 393 aa, Oryza sativa (japonica cultivar-group)
FFTDAYDLFCISLVSKLLGRIYYTDIASDTPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLDTEIQEDADRAEAVAAGGAGNEWGLFSRHFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNA

SEQ ID NO: 5112 - protein, 135 aa, Streptomyces avermitilis MA-4680
MSYDIEKPDEAWRAELTPAEYAVLRKAGTEPAFTGEYTDTRTKGVYSCRACGAELFTSNEKFESHCGWPSFYDPKNTDAVELIDDRSHGMVRTEVRCARCGSHLGHVFEGEGYATPTDQRYCINSISLRLAPDEG

SEQ ID NO: 5113 - protein, 233 aa, Triticum aestivum
MAAAAVDPMVLGLGTSGGASGSGVVGGGVGRAGGGGAVMEGAQPVDLARHPSGIVPVLQNIVSTVNLDCRLDLKQIALQARNAEYNPKRFAAVIMRIRDPKTTALIFASGKMVCTGAKSEEHSKLAARKYARIVQKLGFPATFKDFKIQNIVASCDVKFPIRLEGLAYSHGAFSSYEPELFPGLIYRMKQPKIVLLVFVSGKIVLTGAKVRDEIYAAFENIYPVLTEYRKSQQ

SEQ ID NO: 5114 - protein, 477 aa, Gracilariopsis chorda
KNERYESGVIPYAKMGYWDPDYVVKDTDVLALFRVSPQPGVDPVEASAAVAGESSTATWTVVWTDLLTACDLYRAKAYKVEAVPNTTDQYFAFIAYDIDLFEEGSIANLTASIIGNVFGFKAVKALRLEDMRIPVAYLKTFQGPATGLVVERERMDKFGRSFLGATVKPKLGLSGKNYGIVVYEGLKGGLDFLKDDENINSQPFMRWKERFLYSMEGVNRAIAASGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLKVNLPQGFFFEQDWASLRKVTPVASGGIHCGQMHQLLDYLGIDVVLQFGGGTIGHPDGIQAGATANRVALESMVMARNEGRDYVAEGPEILRVAAKTCGPLQTALDLWKDITFNYTSTDTADFVETPTANV

SEQ ID NO: 5115 - protein, 321 aa, Brassica rapa
MLKEESNESGGTRACDTCRSAACTIYREADSTYLCTTCDARVHAAKRVRVCDSCESAPAAFFCKADAASLCTACDAEIHSANPLARRHQRVPITSNSCGSMATDGDNNVMMVSEEKEDADEVASWLMLNPGKNNQNNGFLFGVEYLDLVDYSSSIDNQFEDQYSKYHRSFGGGEDGVVPLQLEESSTSHMQQSQHNFHLGVNYGYSTEPQYSYVSVVPESLSDTTVQHAKETIDQVCGPPTQMVQQLTPADREARVLRYREKKKRRKFEKTIRYASRKAYAEVRPRIKGRFAKRIDMEADAEQLFSTSVMSNTSYGIVPSF

SEQ ID NO: 5116 - protein, 238 aa, Zea mays; identical to SEQ ID NO: 2312

SEQ ID NO: 5117 - protein, 165 aa, Nostoc punctiforme
  unsure (1)..(165): unsure at all Xaa locations
MCTNDMYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAXAEFVVGYRRCTHRWFWGFFALLMSVYTVRAEGLKTFHGWFLF

SEQ ID NO: 5118 - protein, 510 aa, Glycine max
  unsure (1)..(510): unsure at all Xaa locations
MPSFMAFLSHPYFFAALSASLTLLVVQLLFRKLNKRHSRKKYHPVAGTIFNQMLNFNRLHHYMTDLAAKHRTYRLLNPFRYEVYTTEPTNVEYILKTNFENYGKGLYNYHNLKDLLGDGIFTVDGEKWREQRKISSHEFSTKMLRDFSISIFRKNVVKLVNIVSEAATSNSTLEIQDLLMKSTLDSIFQVAFGTELDSMCGSSQEGKIFADAFDTSSALTLYRYVDVFWKIKKFLNIGSEAKLRKTTEILNEFVFKLINTRILQMQISKGDSGSKRGDILSRFLQVKEYDPTYLRDIILNFVIAGKDTTAATLSWFMYMPCKCPALPEMAAGVVGQAPYTTCLSSYNEFVYSVTDEALERMNYLHAAXTETLRLYPAVPVDAKICFSDDTLPDGYSVNKGDMVSYQPYAMGRMKFIWGDDAEDFRPERWLDENGIFKPESPFKFTAFQAGPRICLGKEFAYRQMKIFAAVLLGCFRFKLKDEKKNVTYKTMINLHIDEGLEIKAFNRYRD

SEQ ID NO: 5119 - protein, 294 aa, Allium cepa
MDQYEKVEKIGEGTYGVVYKARDRLTNETIALKKIRLEQEDEGVPSTAIREISLLKEMQHANIVRLQDVVHSEKRIYLVFEYLDLDLKKHMDSCPDFAKDSRLAKTFLYQLLRGIAYCHSHRVLHRDLKPQNLLIDRRTNSLKLADFGLARAFGIPVRTFTHEVVTLWYRAPEILLGARQYSTPVDIWSVGCIFAEMVNQRPLFPGDSEIDELFKIFRIMGTPNEDTWPGVTSLPDFKSAFPKWPAKDLATIVPKLDSAGIDLLYKMLHLEPSKRITARKALEHEYFRDLGTIP

SEQ ID NO: 5120 - protein, 511 aa, Saccharomyces cerevisiae
MSKSKTKTDKRNQSSLSRIKLSALHYCMSDAEPSIAYLQDNSAFINNEWHNLVLEKIFPVYNPSTEEDITQVSEKSQHDSTEEDITQVSEKSQHDDDKAVVDISERGRLLNILADLIERDRDILAAIEHLDNGKPFDEAYLLDLASVLKELRYTAGWADKLHGTLRFAITIPTFQDLRFLRYTRHEPVGVCGEIIPWNIPLLMYIWKIGPALAAGNTVVLKPEELTPLTALTVATLIKEAGFPPGVVNVVSGYGPTAGAACLSHKDNDKLAFTGSTLVGKVVMKAAAKSNLKKVTLELGGKSPMIVFIDADLDWAVENAHFGVFFNQGQCCIAQSRITVHESIYDEIVERDLEKAKKQVLGNPFESDTRYGPQILKIEFDSIPRLINSAKAEGAKVLCGGGRDDSCVGYYIQPTVFADVTDEMRIAKEEIFGPVITISRFKSVDEAIKRVDNTKYGLAAYVFTKDKAIRISAALKAGTVWVNCVHVASYQIPFGGNKNSGMGRELGEYGLE

SEQ ID NO: 5121 - protein, 177 aa, Cicer arietinum
EGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVSRPDKISAAEISAICQEAGMHAVRKNRYVILPKDFEKGYRTNVKKPDTDFEFYK

SEQ ID NO: 5122 - protein, 424 aa, Methanothermobacter thermautotrophicus str. Delta H
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 5123 - protein, 462 aa, Trichodesmium erythraeum IMS101
MVKLTPNPSFSLTISLETPNRTGMLAKVTQAIASEGGNIGNVDLIKQSRQIIIREITVDAYSTEHIEKIVQAVKTLPEIKLVNVYDRTFDIHKGGKITVQGKIPLKSQADLSMAYTPGVGRISKAIAEDPQQIYNFTIKKNTVAIVTDGSAVLGLGNLGPGGALPVMEGKAMLFKEFAGIDAFPICLATQDTDAIVETVKNIAPVFGGVNLEDIAAPRCFEIEVKLREILDIPVFHDDQHGTAIVSLAALINALKLVKKSIEDIRIVINGAGAAGIAITRLLQKAGANQICLCDSKGIVSKSRTGLNSEKQAFAVESSGTLADALMGADVFLGVSVPGVLTPEMVRSMAKDPIVFAMANPIPEIQPELVAEEVAVMATGRSDYPNQINNVLAFPGIFRGALDCRATTLTSTMYLEAARAIASLVKTSDLDQEHIIPSVFDTRVATAVAGAVASAARTEGVTV

SEQ ID NO: 5124 - protein, 551 aa, Methanosarcina barkeri
MLGKTKRYLEVMRVLLKYNLIPELYRDLRTDYISNPECTCTFDLENRQTAIKLRKAFEDLGPTFIKIGQTMSKRPDLVPHPYVIEMSNLQDKVKPIPFEEMAESLDLACVCEFETLEERKRKKTDAELKASRERKAKAFIEIFDSFDPEPIASGSIAQVYKGVLEGKTVAVKILRPNLIDIINIDLSILDDFRPVMIKVLGLGSNFDIDAFSLEIREMLTREVDLRTEAVNMRRFEDNFKNVKNVSVPRIYPDYCSANVLTMEFIKGTQIKDITNMPVPQSKKSEYTRIITKSYLKQVYIDGFYHADPHGGNMLVQENNTIAFIDFGAVGSIDDELKKNMLKFYYAINNRDVEGATQGFLKIGGADVRDVDIRRLRKDMDSLIANQNYGLEGRQSDNYAKLGLKYDIRLPGEFSTLQRAILLIEGVCLELDPKYNIKTIAIPVLMDAYKKLNTPKGTALHIEFSTEPMDEKAELRDAIREVTDKMEGMGDKFLFLKQKETRKTTFSKELYLAVLLIVSTYILLNGGVFSWVGLAGFAGSVLIALLLAFRGK

SEQ ID NO: 5125 - protein, 404 aa, Methanosarcina acetivorans C2A
MINTGSTGFMLLATSLVMLMTPGLAFFYGGLACKRNILGIMMQSFVSLGLTTILWFFVGYSLCFSGGEGAILGNLDKMFLNGIAPTDMFGDAGFPELVFVAYQMMFAIITPALITGAFANRITFKAYIIFLVVWQLFVYYPFVHMVWGGGLLAEMGVIDFAGGIVVHATAGFAALASVFYVGSRKYKDSKPNNIPLMAVGTALLWFGWYGFNAGSELNVDGITALAFLNSDIAASFAAITWMIIEWLRETKPKFVGLMTGAVAGLATITPAAGLVSMHVAALMGILGAIACYFAVHIKNRMQWDDALDVWGVHGIGGVTGTILLGIFASTAINPVGADGLFYGGTAFFIKELSVVLGASIYAFIFTYIMLMLINVITPVKVSDEEELAGLDISMHGECAYDAIH

SEQ ID NO: 5126 - protein, 134 aa, Staphylococcus aureus
HETDEEINKKAHAIFKYGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 5127 - protein, 489 aa, ASPERGILLUS NIDULANS FGSC A4
MLSMTYYIINNEAASLVHRQAGTYSNNPQVRPQWPSRVLARSSHLRRFNSSAPPYYYQPLQTLKDVDIEIFRDRFFIPELPVLLPRRSFRDLPAYERWFHHTATKPQLNIEYLADHGGDALVPLELTQSERSISISEDPGLSFRKFHAPLSLFLQWIREAQSSSQLQSRLYLAQCQLLDLPQILRDDFPTPTIVAKAGKGDVYDTNIWMGYPPTYTPLHRDPNPNLFVQLAGRKTVRLLGPRDGQAVFSHVRGKLGRSGSREAAAFRGEEMMQGRERGLLEQAIWDDAGKGQSGQCTEGFEAELDAGDGLFIPKGWWHSIKGMGESVTASLLLGLRTATSTSTSTTTSTTLIAQSPASYLFAQCHATNLYSHYNLGKPSTYFYTTMSASDSNLGQPQDQPSETSEKKPILALPSASPDNDTTQLDVNGDGVKLDHLGPLVVNSDGTLSRIANWAQMTEIERRNTLRVLGKRNRERREKLMEEGQGQEQG

SEQ ID NO: 5128 - protein, 317 aa, Arabidopsis thaliana
MGSETPLLPLRLPVIDFSNKNLKPGEPEWDLTRADVQKALQDYGYFEASFDRIPFELRKSVFGALEELFDLPLQTKLRNVSKKPFHGYVGQYPMVPLYESMGIDDSDIAEKVDAFTEKLWPQGNISFSTTIQSFSKKLSELDITIRRMIMESFGLDKYIDEHLHSTNYLLRVMKYKGPDTEETKVGLNAHTDKNIVTILYQNHVEGLEVQTKDKNWIKVKPTQDSFTVMIGDSLYALLNGRLHSPYHRVMMTGTETRYSLGLFSIPKAGHIVSSPDELVDEEHPRLFKPFDHVEFLQFYYTEAGQRSQSALKTYCGI

SEQ ID NO: 5129 - protein, 186 aa, Zea mays
MAPSAALAPVAFRSAFSTPLASKPTRNRINIEGAFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMSDLAQSLGMPAGLGDGLK

SEQ ID NO: 5130 - protein, 368 aa, Oryza sativa
  unsure (1)..(368): unsure at all Xaa locations
PTSAVPTHPKIAPPRASCRYQELLHPSKKQCAKKVPKLPPPAVAGTSFVIDSKSSEETQKVELLAKAEEPTNLFENEGLLSLQSDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLXRQIFKLYFQVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 5131 - protein, 310 aa, Staphylococcus xylosus
GFGRIGRLAFRRIQNVDGIDVVAVNDLTDDEMLAHLLKYDTMQGRFTGEVEVENDGFRVNGQEVKSFSEPDPSKLPWKDLDIDVVLECTGFYADKEKAEAHINAGAKKVLISAPATGDLKTIVYNTNHQELDGKETVVSGASCTTNSLAPVAKVLNDDFGLVEGFMTTIHAYTGDQNTQDAPHAKGDKRRARAAAENIIPNSTGAAKAIGLVIPEIDGKLDGGAQRVPVATGSLTELTVVLDKNVSVEDVNAAMKNASNESFGYTEDEIVSSDVVGMTYGSLFDATQTRVMTVGDRQLVKVAAWYDNEMS

SEQ ID NO: 5132 - protein, 72 aa, Glycine max
  unsure (1)..(72): unsure at all Xaa locations
MASSMISSPAGTTVNPAGAGMDAAWAGLNFMAAXHSKKTNSDIPSIASSGSRVHRMQVWPTTGMRKFETLYY

SEQ ID NO: 5133 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 5134 - protein, 751 aa, Zea mays
  unsure (1)..(751): unsure at all Xaa locations
MWRLKIGEGGGPWMQTVSGFHGRQVWEYDPDAGTDEERSKVEQLRREFTENRFRRRESQDLLMRXMPAATKIEEDGDEVPLTEERLAESLRRALXGMAALQAEDGHWPPGDYSGVMYLMPFWIFALHITGTVDAVLSKEHRREICRHIYNHQNEDGGWGFNVIDESAMFSTCLNYTSLRLLDEVQREENDGLAKGRAWILSHGTATAAPHWAKILLSVIGVYDWRGNNPVVPELWLVPRFLPIHPGRFWCFTRIMYMSIAFLYGKKFVGPITPTILALREELYSLPYVHIDWSKARNSCAKVCHRSSLTLNYYFIAXTCLNMFVEPVLNYWPLNKLRERALNHILEHIHYEDETTQYIGISPVTKALNMICCWVENPNSDALKRHIPRIHDYLWIAEDGMNTKIYDGTHNWELALIIQAMLSADAANEYGPTIQRAMEYLKRAQVTTNPPGNPSYWFRHRSKGSWPLSTIDNGWGSSDTSAEATKALLMISKVYPNLVENSNGDEWMLNAVDCLLSFMNKDGSVSTFECQRTYSWLEILNPLESFRNIVADYPTVECTSSVLQALVLFEEFNSEYRSKEIKENVKKAAIYIENNQNKDGSWYGTWGICFVYGTLYAIKGLVAAGRNYENSICIRKACNFLLSIQLKTGGWAESYHSCERQVYVEGHSTHVVQTAWAMLALIYTGQMERDPTPLHRAAKVLINMQLETGDYAQQEHVGSTNCSVYFNYPNYRILFPVWALGEYHRKVCTKSN

SEQ ID NO: 5135 - protein, 399 aa, Bassia scoparia
MALKLQHPLSLQSSNSTSSFSVPRSHLLRSPNRVFMASTIGVTSKETQNGKKPYMPPKEVHVQKTHSLTPQKIEMFKSLENWAEENLLVVLKPVEKCWQPQDFLPDPASEGFEEQVQELRERTKELPDDYFVVLVGDMITEEALPTYQTMLNTLDGVRDETGASLSPWAIWTRAWTAEENRHGDLLNKYLYLSGRVDMKQIEKTIQYLIGSGMDPQTENNPYLGFIYTSFQERATFISHGNTARLAKDHGDLKLAQVCGIIAADEKRHETAYTKIVEKLFELEPDGTILALADMMRKKVSMPAHGMYDGIDDNLFDNYASVAQRIGVYTAQDYADILEFLVQRWNVSTLTGLSGEGRKAQDFVCGLAPRIRRLEERAQARAKQSSLAPFSWIFGKELTV

SEQ ID NO: 5136 - protein, 175 aa, Oryza sativa; identical to SEQ ID NO: 2331

SEQ ID NO: 5137 - protein, 837 aa, Shewanella oneidensis MR-1
MSHDSELSPNTSGVTPKKRATIAVESLKAVAHDPCEPCDALPASFTRHVRYGLSRGEGARGELFQALALSVKEQMLDDWRETRIKDSHYDNKQVAYLSLEFLMGRTLGNALLSLDLEQDSREALSHYSVSLEELEEAEHDAGLGNGGLGRLAACFLDSCASLDLSVTGYGIRYEYGMFAQKIVDGYQVERPDRWLREGNPWEVRVPHHNVTVHFFGHTESYVDKQGRRHVIWVDTQDVLAVAYDMPVPGYRNGRINTLRLWKAEATDDFDLAEFNQGDYTEAVARKNLAEQITMVLYPNDASENGKELRLRQQYFLSSASLQAILKRWVHHHGHDFTQFAAKNVMQLNDTHPSIAVPELMRLLVDEYALEWDAAWAITRQTMAYTNHTLLPEALERWPVRMMALMLPRILEIIYEINARYLDLVAHHWPGDADKLASMSIIQEGPDPHVRMAYLAIVASFSVNGVAGLHTQLLKSGLFKDFYSLWPQKFNNRTNGVTPRRWLAHCNPALAKLLSSHLGQSWVTDLSQLMALNALTQDASFIQQWREVKQGNKVLLANMIAKECGVEFDPSMLFDVQVKRIHEYKRQLLNILHVIHLYHQIQQGHTEHLVPRCVLIGGKAAPGYFMAKLIIKLASNVAHMVNSDPVVAPYLRFAFLPNYNVSAMEKICPGTDVSEQISTAGKEASGTGNMKFMMNGALTIGTLDGANIEMLEEVGEESFFLFGLNAEQVAAMRSNYQPKRIIAQSHALSEVMALLKSGHFNLLEPGIFDPIITSIESSDDQWMTAADFDSYRLAQEAVANTYKDQQKWTQMSIRNTAASGRFSSDVTIAGYRDEIWKL

SEQ ID NO: 5138 - protein, 556 aa, Zea mays
  unsure (1)..(556): unsure at all Xaa locations
MARRAASSLVSRCLLARAPAGAPPAAPSALRRTVPADGMHRLLPGVLQRFSTAAAVEEPITPSVQVNYTKLLINGNFVDSASGKTFPTLDPRTXGEVIAHVAEGDAEDINRAVAAARKXAFDEGPWXPKMTAYERSRILLXRFADLIEKHNDELAALETWDNGKPYEQAAQIEVPMXVARLMRYYAXGWADKIHGLIVPADGPHHVQILHEPIGVAGQIIXPWELPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 5139 - protein, 328 aa, Zea mays
MDMISGSTAATSTPHNNQQAVMLSSPIIKEEARDPKQTRAMPQIGGSGERKPRPQLPEALKCPRCDSNNTKFCYYNNYSMSQPRYFCKACRRYWTHGGTLRNVPIGGGCRKNKHASRFVLGSHTSSSSSATYAPLSPSTNASSSNMSINKHMMMVPNMTMPTPTTMGLFPNVLPTLMPTGGGGGFDFTMDNQHRSLSFTPMSLPSQGPVPMLAAGGSEATPSFLEMLRGGIFHGSSSYNTSLTMSGGNNGMDKPFSLPSYGAMCTNGLSGSTTNDARQLVGPQQDNKAIMKSSNNNNGVSLLNLYWNKHNNNNNNNNNNNNNNNNKGQ

SEQ ID NO: 5140 - protein, 653 aa, Zea mays
MDHHDSMADSQRRRHNLLRDKVQLVKRKYSDRYEIVRIHDPLSFEKGFFVVIRACQLLAQHNDGIIFVRVAGPSGAGKTVFTEKVVNFMPDVAVISMDNYNDATRIVDGNFDDPRLTDYDTLLENIHGLKEGRSVQVPIYDFKSSCRTGYRTVDVPSSRIVIIEGIYALSEKLRPVIDLRVSVTGGVHFDLVKRVLRDIQRAGQEPEEIIHQISETVYPMYKAFIEPGLETAHIKIINKFNPFSGFQNPMYILKSPRSLGPEKIKAVLGDDHTESNEETYDIYLLPPGEDPEACQSYLRMRNREGKYNLMFEEWVTDNSFIISPRITFEVSVRLLGGLMALGYTIAAILKRSTRVFSDGKATVKIDWLEQLNRQYIQVQGRDRLYVKSVADQLGLDGSYIPRTYIEQIQLEKLINDVMALPEDLKTKLSIDDELVSSPKEAFSRVSADRRNKLMKSARDHYLEHPNRKNIVKLSKLTETNRRFGGGRALEPPAINQGAITQLSEQISTLNERMDEFTSRVEELNSKFTVKKHLPSQQNLALPNDACNGSTPTNLFVSHLGNGTLIPHSSSSNQLSKDSPMIEEIMNITRGQRQVIHQLDNLTNLLHEHLVLTRQTNNTASRNRVLDSDTLICPLICLTVASIGYFMFKGLSRG

SEQ ID NO: 5141 - protein, 65 aa, Zea mays
  unsure (1)..(65): unsure at all Xaa locations
QGGEEGVAVTITWVKARXIFDSRGNPTVEVDVGLSDCSYARGAVPSVSFTGIYEALELRDAGSFF

SEQ ID NO: 5142 - protein, 224 aa, Zea mays
TLSTQHADGQTRDRIQQICWSQRRRPPAAPQDLGPRPVAGGVGAAVGNPADVAMVRMQADGRLPLAERRNYRGVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 5143 - protein, 225 aa, Geobacter metallireducens
MEDAMKKIAPSILSADFSRLGDEVRAVAAAGADYIHVDVMDGHFVPNITIGPPVVEAVRKVTELPLDVHLMIENPDRYIPDFAKAGSDIIVVHAEASVHLHRTIQLIKSLGKKAGVSLNPATPLSVLEYVLDELDLVLLMTVNPGFGGQSFIEACLPKIQALRAMLDRRGCNAELEVDGGVKIDNIDRIAHAGANVFVAGSAVFGSKDYKETIKELKRRAKEPIL

SEQ ID NO: 5144 - protein, 400 aa, Oryza sativa
MASRMALRPNDVTLRLTPPLAAAARRNRRAAAGGVRVYAVASGAVSTKVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKAGTLPFSWVYGREVQL

SEQ ID NO: 5145 - protein, 532 aa, Aspergillus oryzae
MVAGGGVVSSSGMDAYRALPNNTNSNWFKDKGLRRLNFGLMLMFASAAANGYDGALMNGLLTLPMCKFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLGTFYVEGSTWSWRIPCLLQCFFPAVQLVGLLIVPESPRWLVSKDRRDEALQILARYHGNCDTSDPLVQFEFSEICSAIELENSVAHKSGWSAFIATKGARHRLAICLLVGVMIQWAGNGTYRAIHLLLSILLIILSLGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIIYFVFPETKGHTLEEIAVIFDGPGAETEVQRDLAAIIAVEREVKAPMKEELEHAP

SEQ ID NO: 5146 - protein, 165 aa, Streptomyces coelicolor A3(2)
MADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 5147 - protein, 372 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIASKYEEISPPKVDDFCYITDNTFSKQDVVKMEADILLALQFELGRPTINTFMRRFTRVAQDDFKVPHLQLEPLCCYLSELSILDYKTVKFVPSLLAASAVFLARFIIRPKQHPWNQMLEEYTKYKAADLQVCVGIIHDLYLSRRGGALQAVREKYKHHKFQCVATMPVSPELPVTFWEDVTI

SEQ ID NO: 5148 - protein, 426 aa, Burkholderia fungorum
MLNRTGSTRSGTNLAHFLHSLRAFCHKQDISMESLKTGTDTLFLLLGAGMVLAMHAGFAFLELGTVRKKNQVNALVKILVDFSVSTIAYFFIGYAIAYGVQFFGSAESLAAHNGYALVRFFFLLTFAAAIPAIVSGGIAERSKFNPQLFATFVLVGFIYPFFEGIAWNGRFGIQNWLAEMFGAQFHDFAGSVVVHAFGGWVALPAVLLLGARHGRYHRDGGIAAHPPSNIPFLALGAWVLAVGWFGFNVMSAQTVDKISGLVAVNSLMAMVGGTLTAWLAGRNDPGFSYNGPLAGLVAVCAGSDIMHPLGALVTGGIAGVLFVYMFTCVQNRWRIDDVLGVWPLHGLCGAWGGLAAGIFGLRALGGMGGVSFGAQLVGTLGGIVVATLGGTLVYGAIRLTVGLRLDQEDEYNGADLSIHKISATPE

SEQ ID NO: 5149 - protein, 273 aa, Nicotiana tabacum
MTLEALKSPTAATPTLPPRYEDDDEIHNLDSWAKGKRSKRPRIDAPPTEEEYLALCLIMLARSGTGTRTGLTDATTSQQPADKKTAELPPVHKKEVATEQAEQSYKCSVCDKAFSSYQALGGHKASHRKTTTTATAASDDNNPSTSTSTGAVNISALNPTGRSHVCSICHKAFPTGQALGGHKRRHYEGKLGGNSRDLGGGGGGGHSGSVLTTSDGGASTHTLRDFDLNMPASPELQLGLSIDCGRKSQLLPMVQEVESPMPAKKPRLLFSLG

SEQ ID NO: 5150 - protein, 179 aa, Glycine max
  unsure (1)..(179): unsure at all Xaa locations
MAGGQLGVLNALDVAKTQWYHFTAIVIAGMGFFTDAYDLFCISLVTKLLGRLYYTDIRNPKPGVLPPNVQAAVTGVALCGTLAGQLFFGWLGDKLGRKRVYGLTLMLMXLCSIASGLSFGDTXRGVMATLCFFRFWLGFGIGGDYPLSATIMSEYANKKTRGSFIXXAVFAMQGFWNHG

SEQ ID NO: 5151 - protein, 503 aa, Brassica napus
MAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 5152 - protein, 279 aa, Methanosarcina barkeri
MSWEDVGGLEGVKQLLKEAVEWPLKSPESYRDIGVEAPKGVLLYGPPGTGKTLLAKAIAHESEANFITAKGSDLLSKWYGESEKRIAEVFSRARQVAPSIIFLDELDSLAPIRGAAIGEPQVTARILNQLLSEMDGLEELRAVVVIGATNRPDIIDPALLRPGRFDELILVPVPDAGARKEIFRVHTAKMSLAEDVDIDKLVSMTDQYTGADIAAVCKKAGRDALREDLHAKEVKQKHFLQAIAETGPSVTPDTMKYYQAVQSGLRKRQSKEIETPFYT

SEQ ID NO: 5153 - protein, 175 aa, Glycine max
  unsure (1)..(175): unsure at all Xaa locations
AAAKAAKDAGVVLSYDPXNLRLPLWPSADSAREGILSIWETADIIKISEEEISFLTKGENPYDDAVVHKLFHPSLKLLLVTEGAEGCRYYTKEFSGRVKGLKVDAVDTTGAGDAFVAGILSQLAVDLSILQNEDELRDSLKFANVCGALTVTERGAIPALPTKEAVLNAMLKPVS

SEQ ID NO: 5154 - protein, 210 aa, Oryza sativa
SGSPARGLRHEEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYE

SEQ ID NO: 5155 - protein, 114 aa, Klebsiella granulomatis
MDKQYPVRQWAHGADLVVSQLEAQGVRQVFGIPGAKIDKVFDSLLDSSIRIIPVRHKANAAFMAAAVGRITGKAGVALVTSGPGCSNLITGMATANSKGDPVVALGGAVKLPHK

SEQ ID NO: 5156 - protein, 103 aa, Solanum tuberosum
PVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAE

SEQ ID NO: 5157 - protein, 196 aa, Zea mays
MDLSAVQAALSDKSYTAVASLCDELLLQAASKGTNTDEWPYSVHLLAHLYINDLNSARFFWKSLPQEVKDTQPELAAVWRIGQCLWNRDYAGVNTAAQGFEWGPDLTEFITAFLESYRQRIFKLLTSAYSTISVADVAHFMGMSEEDATNYAVQIGWSLGAATKMLTVKKPKAQINQKLDASKLQRLTECVFHLEH

SEQ ID NO: 5158 - protein, 346 aa, Porphyra yezoensis
PSLMPGGPRSAYEALEPMLRSIAAQVDDGPCVTYIGTGGAGNYVKMVHNGIEYGDMQLIGEAYDVLKTVGGMSASEIAAVFEEWNESNLQSFLVEITAAILRTSDDLVGDGSALVEKVLDQTGAKGTGMWTVQEAAARLVPIPTIAAALEARYLSALKEDRTAASAVLAGPSTDAAPSVTAEEKAALVAAVRSALYASKICSYAQGMNLIRAAGKEYGWGLDLGSISRIWKGGCIIRAVFLDRIKAAYDVDAELASLLVDPGFASELASAQSAWRSVVTTAINAGVSVPAMSGSLAYYDTYRRTVLPSAQMVQSQRDFFGSHTYKRLDKDGVYHTRWSSDGVTETQ

SEQ ID NO: 5159 - protein, 1916 aa, Gibberella moniliformis
MVSPSGAILAPPAVASLRAQQTTAMERSLSQDIREEREELREAAEQTLNTIVDLNLDGTIKWVSPSWTDVVGTQFETVSGLPISDLIVSDNKNVFTEVVESMKKDDSRSHRVRFAVNIGPLSKLLPIDDLENDPENEQSHAVDLEAQGIMVYDSVSGGESHTMWMIRPWIAPREIKIDLPNVIVDSLGSGAEVLASYLTQLAESGLDDPEQQEPPPPVLCRICERQIPRWWFEKHTDLCLQEHRAEMDVQMAQESLTEHRHSIVKVLDALEARKSRSLAGDQTPVPVAEYKGLPIGPPPSTQSSPGSSLPRSRERSGGLGHTRARSFAIRRPQARIVELLMDLCDTAIEISTPAIKESSTQQSGDFRTQSPQSESRISQVLQWQSPSTNTLEQEQGLALLCADTEKVARNKVDAVFRHRKIIEYAERIRIELACLVQDCIDEALRKAARIANGELTDSTEEERLNSEYEQCDTCDEGTGDDDIPPEPLVSEPQHLLQRGSESFTEPLSNPSVLATALRQMNLSENKDRSRPTSFVASTRSSSPKECPTPRSHFGGQSSLGVQARDTRRDSVYLEGDFLDSEGSFRSSSVASRNAPRTESPISEFGDLRRAASTRRRHRRSLILPGTSSPHRQESPSRPGQPSSPLRIKARGFPMSQEGVVSPEASPMLPGSDFSSPATHSHRHHRRQSSAAISDFVMKPPPSPRLGANQAPPQPRPTQPSIKDFEIIKPISKGAFGSVYLSKKKSTGEYFAIKVLKKADMVAKNQVGNVKAERAIMMWQGESDFVAKLYWTFSSKDYLYLVMEYLNGGDCASLIKVLGGLPEEWVKKYLGEVVLGVEHLHSRGIIHRDLKPDNLLIDQKGHLKLTDFGLSRLGLVGRQKRALNSENSDGTPDLLKQGPFARSASIASSRSASLDLHGHTHSPGQTPQMTPEVGSLAQPSYFSLGQETRRVSGTHRSDSGGSETLARMVTNFSLHDAEIASQSNSVRSPLDEEAVAQGSPDLPMSVSSRMSMDSHVRNSLPLSNMMPPPMALFNPEDTNRRFVGTPDYLAPETIKGDKQDETSDWWSVGCILFEFLYGIPPFHAGEAEEVFENILARKIQWPDENECEPISEEAKDLINKLLCMEPHQRLGSNRDDKFASGGEEIRHHPWFQDVNWETLLEDEAQFVPQPENPEDTEYFDARGAVLQSFAEEMEDQASPQSSAAGSEYAERPHDALSRVRSQVNSINRKLMPLHIPPHVRDLKSRRLSEPVAMDDFGSFSFKNLPVLEKANKDVIQKLRAEALATQSKGTSVSPGAPSNVISPGPSLEGSPVLSNPVSRTISNAKATNRAQSPSGFGHTSASPNRASQPSSPLLVSFVAGPGADGRRKASSNSSSLSHQSTAASLQPGSAFEIPKVPPSLQKAATTVAASSPVQSRSAAPPPLSLSPQKTISTPRQSSNSSAGRSRSLTVGSQSQDGSPVASDIMHHHRNRRSQVFDMSPSSSDNEGEKHNALLRVQRRRQSSRRLSQIAFDGGPTFRPLDVLICEDHPVSRMVMEKLLEKLRCRTISVPNGSEAVRYSMSEIKFDVIFLEYQLPQINGADVARMIRETKNANSHTPIVAITAYLKELQAPHYFDSLIEKPISSSKLTEVLRGLCQWRPESPGQSSSMPRPIPMGIRKANSRLEDSPTSGSSIFASRLGNAMMSSREDSITSSLFGDSESVTTDELPVVVSRKPTNEWDEGGLNITDNNDASDPLRKGVPSLVAQQSAPAQMEHRPRSNDKLRGRREGPEHRTLEGTESADDEDEELGSGREKHHGRNSQQILSKAGLPSSKLGIEMMRANSHDSLTVGSESTPEAVTQVVTTPSKEMETGVLDGEVVAEPTARTPPDAGLKAEGVTPNKEKDGTDSVDATPRPLTVVKGDDDGGNDGEATPRPTEK

SEQ ID NO: 5160 - protein, 141 aa, Glycine max
  unsure (1)..(141): unsure at all Xaa locations
MACSHLAAASSPAAACTTLRARATSPVAGFARLPATLHPESGGLALRGRRAVTPVVVAAETAAAAPVADRDGTPAAVKQPIIVIDNYDSFTYNLCQYMGELGLNFEVYRNDELTIEEXKRMXPRGILISPXTGEPQXSGIS

SEQ ID NO: 5161 - protein, 561 aa, ASPERGILLUS NIDULANS FGSC A4
MVLDQYTYIFAIGTIFAMLDAYNNGANDVANSWATSVSSRSISYRQAMVFGTIFEFLGAVTVGARTADTIKNGIIPPEAFEGNAGVQMLAFACALAAASSWVMWCTRHSTHVSSTYSLVSAIAGVGVATAGASSVQWGWNKGNGLGAIFAGLGMAPAISGCFGAIIFLLIKFVVHMRRNPVPWSVWTAPFFFLIAGTVCCLSIVYKGSPNLGLSKKPPGWVAGVTLGTGGAVCLLSAFFFVPFAHARVIKKDYTLKWWMFLYGPILFSRPAPADATSAELSSVPNYAVMQDDGLPPDSPETLVDEPLPPAAQSEKNPSASATEAQLDYKELVARGQERFHAKLRRGRGPLAWAMRTLHDNPIGSGEIYELHNIKILLKRIPAMITVGLLYGLHYDIHAAQSGIHGTPEGARMERVYAHATKYPNEVEHTYSFVQILTACTASFAQRRQATSGTPLGRGRFSTLPGPPARPITYHSPSRGCSMELGAAITVLVFSQYKLPVSTSMCITGATVGVGLCNGTLKAVNWQRVGLLGLGWIMTIPIAGTLAGCLMGLILNAPHFGS

SEQ ID NO: 5162 - protein, 61 aa, Saccharomyces cerevisiae
QNIVGSCDVKFPIRLEGLAFSHGTFSSYEPELFPGLIYRMVKPKIVLFIFVSGKIVLTGAK

SEQ ID NO: 5163 - protein, 422 aa, Zea mays
LGPRAGRKWSMFGGGVTFLVGAALNGAAKDVGMLILGRVLLGVGVGFANQSVPVYLSEMAPARLRGMLNIGFQLMVTIGILCANLINYGTAKIRGGWGWRVSLALAAVPAAIIAVGALFLPDTPNSLIDRGYTDAAKRMLKRVRGTDDVEEEYSDLVAASDESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKGYAAIVVLFICAYVAGFAWSWGPLGWLVPSEIFPLEIRSAGQSINVSVNMVCTFIIAQAFLPMLCRFKFGLFYFFGGWVVVMTVFIAFFLPETKNVPIEEMVLVWKSHWFWKRFIADEDVHVGIGNNHPAKNGSDTKGADA

SEQ ID NO: 5164 - protein, 854 aa, Cellvibrio gilvus
MHRKNHAAAAARTALVAAIAAAFPLFTPGAFAAPEPAEPAQKPWLDASLDADQRARLAVQAMTQQEKLRWVFGYFGHDFGKSKKHPDALPQSAGYIPGTPRLGLPALFETDAGQGVASQSGANVRERTALPSGLSTASTWDPKVAYAGGAMIGSEARASGFNVMLAGGVNLQREPRNGRNFEYAGEDPLLAGTMIGQAIKGVESNRIISTLKHFVLNDQETGRNELDARIDKAALRMSDLLAMELALEQSDAGSVMCAYNRLNGPYTCEHPWLLSEVLKRDWGFRGYVMSDWGATHSTVAAANSGLDQQSGQEFDKSPYFGGALEEAVKTGAVPQKRLDDMVTRIVRTMFGKGVVDNPLKPGVAIDFAANGGQPPDGEEGMVLLKNEGRLLPLAKTVRTIAVIGGHADAGVLSGGGSSQVYPVGGIAVKGLLPATWPGPVVYYPSSPLRAIQAQAPNAKVVFDDGRDPARAARGRWGRRRPGLRQPVDRRGQRRPDARAAGRPGRADHVGGGRQRAHRGRAADRRTGHHALAGARSGRAGSLVSGHQRRRGDRECAVWRGQSVRPPAGHLPAIRAATAAPETRWRSEEPRAAVRRRLPRRCGGRLQVVRPEGPQAAVPVRARPVLHNLRVLRSVRPAQGWPPARALQGDQHRQRGRQGRAAGVRRADVHQMGGAEAPGRLEQGRPAAGRDQGSRGRGGAARAGHVRREVAHLAPSERQDPLDAGRRRLRRQRHQRDRRAACQHAGRTRPRTLTPGETHATTHPLGRLAGASGARPGRGSATPATGQPVPGPHGAATPGGRRVGSPVARELITVSGFGGSGRPAPTRPDASLSPCRACPRDGPIPSRSRAAAASR

SEQ ID NO: 5165 - protein, 375 aa, Zea mays
  unsure (1)..(375): unsure at all Xaa locations
MSGGVEPDTPPGSSSSSSRSGGSTPVGGKPPRHHLTSIRHCASSARIAAASAEFGLESGTLSLISPTADIRPGFLPVFRSGSFADIGPKSFMEDEHVCVDNLVEHLGLRGPGIPAPGAFYGVIDGHGGTDAAXFVRKNILKFITEDCHFPNSIEKAIRSAFVKADHAIADSQSLDRNSGTTALTVLISGRTLLVANAGDCRAVLGKRGRAVELSRDHKPSCSVERLRIENLGGTVFDGYLNGQLAVARAIGDWHMKGSKGSVCPLTPEPEFREVRLTEEDEFLIIGCDGLWDVMSSQFAVSMVRKELMEHNDPQRCSRELVHEALRRDCCDNLTVVVVCFSADPPPQIEVPRFRVRRSISMEGLHTLGGALDSNV

SEQ ID NO: 5166 - protein, 189 aa, Thermoanaerobacter tengcongensis
MMVLIIDNYDSFTYNLYQYVGEMKEEVMVVRNDEITVEEVAKLNPNKIILSPGPGRPENAGVCVELIKNLGQKVPMLGICLGHQAIGYAYGAKIVKADRIMHGKTSLIFHNGRGIFKNIKNPIEGMRYHSLVIDRNTLPEELEITAQTEEGVIMGVRHRKYPVYGLQFHPESILTEQGKEILRNFLEVF

SEQ ID NO: 5167 - protein, 99 aa, Triticum aestivum
MAGKLYQLMARLHLAKGRASADVPKGHFAVYVGEQRKRFVIPTAYLRHPSFLVLLKRVEDEFGFDHRTGGGLTIPCSEGDFADIVGGCSSSSSPAVDYH

SEQ ID NO: 5168 - protein, 391 aa, Zea mays
MALRLHDVALCLSPPLAARRRSGGSFVAVASMTSAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKIAMPAHLMFDGQDDKLFEHFSMVAQRLGVYTARDYADILEFLVDRWKVADLTGLSGEGNKAQDYLCTLASRIRKLDERAQSRAKKAGTLPFSWVYGREVQL

SEQ ID NO: 5169 - protein, 726 aa, Podospora anserina
MKRLLTWATLVGSMSAVTKAACPFADPNYHLAKRDEGASQQTENILEEYEVDDSNAYMSSDVGGPMEDQNSLKAGYRGSTLMEDWIFRQKIQHFDHERIPERAVHARGAGAHGTFTSYADWSNITAASFLGGAGKKTPVFVRFSTVAGSRGSADTARDVHGFATRFYTDEGNFDIVGNNIPVFFIQDAIRFPDLIHSVKPSPDNEVPQAATAHDSAWDFFSQQPSTMHTLFWAMSGNGIPRSYRHMDGFGVHTFRFVTDDGNSKLIKWHFKTKQGKASLVWEEAQVLAGKNADFHRQDLWDAIESGNGPEWELSVQIVDEEKALAFGFDLLDPTKIIPEELAPLVPLGIMKLDRNPTNYFAETEQVMYQPGHIVRGVDFTEDPLLQGRLFSYLDTQLNRNQGGPNFEQIPINRPVSPVHNNNRDGAGQMLIHKNVYPYTPNTLNGGYPLQANQTHGKGFFTAPNRIVDGKLVRALSPTFDDHWSQPRLFYNSLTRVEQQFLINAIRFEASHLKNEQVKKNVLEQINRVSNDVAKRVAVALGLEAPAPDPAFYHNNVTAGLSIFNGTLPTIATLRVGVLASSFNDGSLAQARELKEQLSKEGVVVTVVGEVLKEGVDQTYSAADATGYDAVVVTDGAEGLLTGGKNSPLFPAGRPGQILVDSYRWGKPVAAVGENSGQALEQTVGVSRGQDEGVVVGEGVEQVVKGVEEGLRVFRYLGRFPVDEGAE

SEQ ID NO: 5170 - protein, 709 aa, Pseudomonas aeruginosa PAO1
MSEQNNEQRSQAAGTDTVDRGNSNAKLEQLEAYREDATGEALSTNTGTRIADNQNTLKAGERGPSLLEDFIMREKITHFDHERIPERVVHARGSAAHGYFEAYEDLSDLTKAGFLAEAGKRTPVFVRFSTVQGPRGSADTVRDVRGFAVKFYTDEGNFDLVGNNMPVFFIQDAIKFPDFVHAVKPEPHNEIPTGASAHDTFWDFVSLTPESAHMVMWLMSDRAIPIAYRNMQGFGVHTFRLVNAAGESVLVKFHWRPKSGTCSLVWDEAQKLAGKDPDFNRRTLWEDIEKGDYPEWELGLQVIPENQQDSFDFDLLDPTKLVPEELVPVRVVGRMVLNRNPDNFFAETEQVAFHVGHVVPGIDFTNDPLLQGRLFSYTDTQLLRLSGPNFNEIPINRPLCPFHNNQRDAPHRQTINRGRASYEPNSIDGGWPKETPPAARNGGFSTYHEPVSGSKLRKRADSFADHFSQAALFWHSMSEAEQAHIVAAYSFELSKVERQSIREREVNQILLNIDPQLAARVAANVGVQLAAPANPTPQPKPSPALSQMNLLSGDIRSRKVAILIADGVAESDVSDLRDALRQEGADAKLIAPSASPVQAENGAELSPEGTWDGLPSVAFDAVFVPGGAASSQAIGADGRGLHYLLEAYKHLKPVAFAGDAQALASQLSLPGDPGVVLGATATDVFPGLRQALMQHRIWQREAATKAIPA

SEQ ID NO: 5171 - protein, 529 aa, Pleurotus sajor-caju
MPTQEVFDKKDGAVYTTSNGAPVAEPYAAQRAGLHGPLLLQDFHHIDLLAHFDRERIPERVVHANAAGAHGYFEVTHSCADITSNKLLCSVGKKVRLTARFSTVGGESGSADTARDPRGFALKLRTEEGNWDWVFNNTPIFFIRDPAKFSHFIHTQKRDPQTHLKDADMFWDYLGQNPESIHQMMILFSDRGTPDGVHQMHGYSGHTFKWLKDDGSFTYVQVHCRADSGFKTLDGETAHRLTADNPDYSTEMLFRTIEAGKFPSWTVYIQTMTPEQAENFRYNILDLTKVWPHKEFPLRPIGRFVLDENPKNYFAEIEQAAFAPSHLVPYIEPSADPVLQSRLFSYLDTHRHRLGANYHQIPVNAPIVPVANFQRDGPMTVNNNQGNRPNYQSSIQPLTYISNKETLEAGCRNQERMARHENFIGGAYRDLGEITELDFEQPRALWQKVWNDQQREAYVKNVAGHFGGVKSPVVRDRQLSVWAAVDQDLSDRIAKAVGAKPVAPLKVKPAAEALRFRCNIGGPPGPSRL

SEQ ID NO: 5172 - protein, 356 aa, Enterococcus faecalis V583
MNNLFIFVCFCFMWLMIFGVILYYVGLVNHRYIHHTLILGLVTIISGTLCWLFVGYSLSFFGNIQYSIFYSPLASSEIVSILIQLLFCLYSVIMIIGSVLERGNWKYIVLFVPLWIVFVYAPICFSLWGHGNWLGKMGVLDYSGGLVVHTTAGIGSLVLAITSPIRLKNSLIFKSQEMIAFVGMLFITLGWFGFNMAPSGKIGEEAIQVWLNTLISILGGSISWTFTQWILIKKVSIYSIMNGIIGGLVGSTCSVGYVSPAFSLLISVIVCTLCPIVIHIMHLSIANFDDAADSFGMNAVGGIAGSILTGVMAEKGDFFLQLFGTFLISIWSLSLSLLIHYLLKKIVNDCYSQCIK

SEQ ID NO: 5173 - protein, 360 aa, Oryza sativa (japonica cultivar-group)
MGNDEAVVTQKMGKAPSPPKDHPALSPYLDWSNMQAYYGPGILPPTFFSPGIAAGHTPPPFILGPQPLVPSAFGKPYAAIYPPGGAFSHPFMPLMVSPLSMEPAKSVNSKDSCSNKKMKEIDGAAVSTGSGNSEKTSGDCSLEGSSDGNNQKASGTPKKRSIDDRPKSGVETGGALTPNDRPSEQAALPNLCIPVTAIKPDVSTASDFRVIATPVTEVPTKDDKESKRERRKQSNRESARRSRLRKQAETEELARKVELLTAENTSLRREISRLTESSKKLRLENSALMEKLTETGPDEAQEVPPVKTKAQQARGVENFLSMIDKTGTPRSSGHMDHAIATPKLRQLLGSGLATDAVAAR

SEQ ID NO: 5174 - protein, 83 aa, Capsicum annuum
MAILRMIKKSSTTRDVPKGHFAVYVGETQKRRFVVPISFLSEPLFQDLLSQAEEEFGFDHPMGGVTIPCSEDLFTDLTFRLRK

SEQ ID NO: 5175 - protein, 369 aa, Rhodobacter sphaeroides
MANPSLLILAGDGIGPEVMAEVKRIIGWFGEKRGVSFDVSEDLVGGAAYDAHGTPLADETMARAQEVDAVLLGAVGGPKYDVLDFSVKPERGLLRLRKEMDLYANLRPAQCFDALADFSSLKRDIVAGLDIMIVRELTSGVYFGEPRGIFPDNEGGRFGVNTQRYTTEEIRRVARSAFELARRRNNRVCSMEKANVMESGILWREEVQWVHDNEYPDVELSHMYADNGAMQLVRWPRQFDVIVTDNLFGDILSDCAAMLTGSLGMLPSASLGAPMANGRPKALYEPVHGSAPDIAGQGKANPIACILSFAMALRYSFDMGEEATRLEKAVETVLADGVRTADLMGPEGGTPVSTSGMGDAVLAALDASL

SEQ ID NO: 5176 - protein, 291 aa, Glycine max
IRLERLEQRLTKCQPAEAPEPNQLIWPNLKIKYFQRELRQYLVYFIVALTIFFYMIPITFISAFTTLDNLVKYLPFIKPIVNIKALKTVLEAYLPQLALIIFLALLPKLLLFLSKFEGIPTESHAVRAASGKYFYFTVLNVFIGVTIGGTLFKAFKRIREHPTLDEISSLLAESLPGNATFFLTYVALKFFIGYGLELSRIVPLIIYHLKRKYLCKTEAELKEAWRPGDLGYGTRVPGDMLIVTIVFCYSVIAPVIIPFGALYFGLGWLVLRNQVKFLEFCLMNPVLCFMW

SEQ ID NO: 5177 - protein, 323 aa, Glycine max
MVGVISLVTGMAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILINNAGVMFCPFKLSEDGIEMQFATNHLGHFHLTNLLLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 5178 - protein, 606 aa, Pinus thunbergii
MQAEEVPSPWIDSQSYEAQPRSLQMQQEHHDLCEFVQESQQMPFQVQLDPNSNDTMFADCSLQLPPGSGMVGLSALKTWLRQNPSNADHHKVVPSGSGSPGKSNLGGGLGDFQSLTLSMSPGSQNSSAIISQPTIIDQCTPVETKKRGAGKAGTKEPVPRKSIDTFGQRTSQYRGVTRHRWTGRYEAHLWDNSCRKEGQTRKGRQVYLGGYDKEEKAARAYDLAALKYWGPSTHINFPLETYEKEIEEMKNMTRQEYVANLRRKSSGFSRGASVYRGVTRHHQHGRWQARIGRVAGNKDLYLGTFSTQEEAAEAYDIAAIKFRGISAVTNFDISKYDVQRICSSSTLIAGDLAKRNKEIEQSSEPSGDSPLQIEAAAPLQIEAAHNSQSRSHNDNAKDGNNSTSNDSHHNNNVVGSMSDKIAQDWQLMDSNSEQDQHKVFNNWVVENEDRKPDQSFIESLQLGPHSHSAVLHDLIGLDSSTAADSDQSNNEETSRLLTDISGGNNSLLTMSNASNTGPVESPVNSASENEEGHHRKIPVYDNMMPAGEFPQALFFSSPQQASKLVKYENGSTTLSPWMIPPNTVPPLQSRPNLSVGHLPMFALWNE

SEQ ID NO: 5179 - protein, 381 aa, Oryza sativa
  unsure (1)..(381): unsure at all Xaa locations
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNGANSRALGTPISPPPGVIVPSHTGVSTELLIKDERELKREKRKQSNRESARRSRLRKQAETEDLATQVESLTAENTSLRSEISRXLSESSEKLRLENSALMGKLKDPAASTQAETSLQKTTTASSPRVVENFLSMIDNTNKTSVRHTEHAEPKLRQLLGSGPATDVVAAS

SEQ ID NO: 5180 - protein, 275 aa, Zea mays
MASSNSNSSSNPLEAMGAFFSKQVDRRKLVTTEKRALATRLSSSGDTFPGSEHRPADRKRWMAELGADKLRVHQVVWPGTHDSATDRIGVPFVTRPFAQCQSLSVYEQLALGARVLDVRVQKGRRVCHGVLATYPVDVVLDDVARFLGETESEVVVLEVRTEFGHEDPPEFGRFLVERLGEHLLIPQDEAVFHKTVAELLPRRVICVWKPRRSPAPGPGEPLKFLGQQPPVAGRGFLYRVENTVTPRPDNPVVCVWPVTRRIHGYARMFIAEVFG

SEQ ID NO: 5181 - protein, 384 aa, GIBBERELLA ZEAE PH-1
MAEHNIVVLGGDHCGPEVVAEGIRVLKALEENKPSVGKFNFKDHLMGGCSIDANGSPLTDETLAAAKGADAVLLGAIGGPKWGTGAVRPEQGLLKLRKEMGTYGNLRPCFFASDSLVDASPLKAEVCRGTDIVIVRELTGGIYFGERKEDDGSGSAWDTEPYSREEIERIARLAGFLARGRGDKKVWSLDKANVLATSRLWRKVMNETFEKEFPDLKVEHQLIDSAAMILIKNPTGLNGVVVTSNLFGDIISDEASVIPGSIGLLPSASLSGIPDGQGKCNGIYEPIHGKLYMTPFVSNRKLIHLTGSAPDISGKGIVNPVGTILSVAMMLRYSLNLPEEAKIVEAAVRNALDGGLRTKDMGGNAGTKEVGDKVVEELKKLLKA

SEQ ID NO: 5182 - protein, 1314 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRALLGKVFGSRPHYEGYCCGTTDRPLDDTNP

SEQ ID NO: 5183 - protein, 158 aa, Triticum aestivum
  unsure (1)..(158): unsure at all Xaa locations
MAMAPATSPRHLLLLLFLWLCAAASTAWAHGGGGDADSGDADGGGEAKPDLRARGLVATKLWCLALVFAGTLAGGVSPYFMRWERGVPGRWAPFXGGVFLNTAMXIXSTTQRTSGDSSPTAXPFAXISPAPVLLNMLANAQLSXVXAANXAAARTKEL

SEQ ID NO: 5184 - protein, 449 aa, Triticum aestivum
MQQRMKQAAAVAAQQQQQMMQQALLMHQHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFAFFSAYSTSSDARVMWDQQTGRSRGFGFVSFRNQQDAQTAINELNGKWLGNRQIRCNWATKGANAGEEKQSTDSKGMVELINGSSEAGKENANEDGPENNPQYTTVYVGNLPHDINSNDVHRFFHLLGAGSIEEVRVTRDKGFGFVRYSTHEEAARAIQTGNGQLIGGRQIKCSWGSKPTPPGTASAPLPPPALAPYTPGVSAVDLISYERSLALSKMAANPALMGQVAALRQAAMGMGTGASQAIFDGSFQSVNPQQQQQQQQQQQLMYY

SEQ ID NO: 5185 - protein, 511 aa, Gerbera hybrid cultivar
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 5186 - protein, 312 aa, Capsicum annuum
GINGFGRIGRNFLRCWHGRKDSPLEVIAINDSGGVKQASHLLKYDSTLGIFDADVKPVGTDGISVDGKVIKVVSDRNPINLPWKDLGVDLVIEGTGVFVDREGAGKHIQAGAKKVLITAPGKGDIPTYVVGVNADLYSPDEPIISNASCTTNCLAPFVKVLDEKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFRESADKELAGILSVCDEPLVSVDFRCSDVSSTVDASLTMVMGDDMVKVIAWYDN

SEQ ID NO: 5187 - protein, 405 aa, Zea mays
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKPIYNHVTGLLDPPELIAPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSTISWVPCGRKLTCSYPGIKFSYGPDTYFGNEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 5188 - protein, 131 aa, Triticum aestivum
  unsure (1)..(131): unsure at all Xaa locations
MAPTVMASSATSVAPFQGLKSTAGLPVSRRSNGASSAAXHNGGRIRCMQVWPIEGIKKFETLSYLPPXSTEALLKQXDYLIRXKWVPCLELARXGXFREHKXSPGYXDGXYWTXGXAMFGALXHTGXNXVE

SEQ ID NO: 5189 - protein, 351 aa, Pseudomonas aeruginosa UCBPP-PA14
MSKFWSPFVKDLVPYVPGEQPKLSRLVKLNTNENPYGPSPQALAAMQAELNDDLRLYPDPNGERLKQAVAAHYGVQANQVFVGNGSDEVLAHIFHGLFQHDLPLLFPDVTYSFYPVYCGLYGVAHEKITLDERFRIRVEDYARPNGGIIFPNPNAPTGCLLPLDAIEAMLKASPDSVVVVDEAYVDFGGESAIALVDRYPNLLVTQTLSKSRSLAGLRVGLAVGHADLVEALERIKNSFNSYPLDRLAIAGAAAAFEDDAYFRRTCQAVIDSREALSASLQALGFEVLPSAANFVFARHPRHDAGQIASTLREQGVIVRHFKQARIDQFLRITIGSPEQNQALLDALHFLK

SEQ ID NO: 5190 - protein, 165 aa, Secale cereale
VMASSATSVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCV

SEQ ID NO: 5191 - protein, 264 aa, Oryza sativa
  unsure (1)..(264): unsure at all Xaa locations
MFVEGFRVESPRVRYGDGEIESEYRYDTTEVVAPPSPEKGWVVRPKSVTYHFKTTTTVPKLGVMLVGWGGNNGTTLTAGVIANREGISWATKEKVHKANYFGSLTQSSTIRVGSYNGEEIYAPFKSLVPMVNPNDIVFGGWDISSMNLADAMTRARVLDIDLQKQLRHHMESMVPLPGVYNPDFIAANQGSRANNVIKGTKKEQVEQVKKDIREFKEKSKVDXVVVLWTANTERYSNLVAGMNDTMDNLLASLDKDDPEMSXST

SEQ ID NO: 5192 - protein, 188 aa, Zea mays
ALPEPQRPCMSRRATVQEQISSPFMDSPPPHLDAPFFGADLIPSGRLRRMRGYRYSPGGLEEEIMMFQTRVLLGGMNMYDRYQDWRLDVDNMTYEELVELGDRIGYVNTGLREDEIARSLRKAKHPSFGSLRFAAEVERKCTICQEEFQSNEEMGRLVCGHSYHVLCIKQWLSQKNTCPVCKTAVSKN

SEQ ID NO: 5193 - protein, 496 aa, Zea mays
  unsure (1)..(496): unsure at all Xaa locations
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDHVGVPSDYRHMEGFGVNTYTFVSAAGKAQYVKFHWKPTCGERSILTDEEARVGGRNHSHTQDLYDSIAAEGSFPEWTLYVQVMDPAQQEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVXRRFADSLGHPNVSQXLRSIWIDLLAKVDASLGMKIATRLNMKANM

SEQ ID NO: 5194 - protein, 252 aa, Oryza sativa
GLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVAVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 5195 - protein, 300 aa, Leptonema illini
RIGRMVFRAVVEQNRNVEIVGINDLLDAEYMAYMLRYDSTHGRFTGDVKVEGGQLIVNGKKIRVTAESDPANLKWNEIGAEYVIESTGLFTTLEKTQAHLKAGAKKVVISAPSADAPMFVMGVNHSSYKNDMDIVSNASCTTNCLAPITKVINDRWGVEEGLMTTVHAVTATQKTVDGPSKKDWRGGRGAYQNIIPSSTGAAKAVGKVIPELAGKLTGMSFRVPTSNVSVVDLTVRLKKPAKYEDICKAMKEESEGAMKGVLGYTDEEVVSNDFLHDARTSIFDAKAGIQLSDTFVKVVS

SEQ ID NO: 5196 - protein, 454 aa, Padina crassa
VKETDILALFRITPQPGVDPVEAAAAVAGESSTATWTVVWTDLLTACDIYRAKAYRVDPVPGTNDQFFAYIAYECDLFEEGSLANLTASIIGNVFGFKAVKALRLEDMRIPFAYLKTFQGPATGVIVERERLDKFGRPLLGATVKPKLGLSGKNYGRVVYEGLRGGLDFLKDDENINSQPFMRWKERFLYCMEGVNRSAAATGEVKGSYLNVTASTIEQMYERAEYADSLGSVIVMIDLVIGYTAIQTMAIWARKAQMILHLHRAGNSTYARQKNHGINFRVICKWMRMSGVDHIHAGTVVGKLEGDPLMVRGFYNTLLLTQLKVNLAEGLFFDMSWASLRKCVPVASGGIHCGQMHQLLYYLGDDVVLQFGGGTIGHPDGIQSGATANRVALEAMVLARNEGRDYVAEGPEILRTAAATCGPLKTALDLWKDITFEYTSTDTPDFVEVPTGSN

SEQ ID NO: 5197 - protein, 294 aa, Triticum aestivum
MGGLSLQHPWAFAFGLLGNVISFMTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFIAPLSVIRLVVRTRSVEFMPFSLSLSLTVSAVVWFLYGLLIKDKYVALPNILGFAFGVIQMGLYALYRNAMPSPAPKQVDDADAIKVPEHVIHIAKLGPAAAIELNTHNPMERGMPPPMEDNGLACASDMTKGGIDMVEKATRVEQV

SEQ ID NO: 5198 - protein, 386 aa, Thlaspi caerulescens
MAATSNSGEDPVLYNHRSPFRFELLQSLPPTDPRYSSQTPSSTNRPFSVSEPLPNAQSPQIPPHWDESYSQITQKVQKSRKNHRIQLGSISNMPGETIDIAKVIVKQESPQDTKRGIKSKVAKQLKAGKRMANTEAHNGGPNGTNNCRYDSSLGLLTKKFVNLIREAEDGSLDLNYCADVLEVQKRRIYDITNVLEGIGLIEKTTKNHIRWKGADNLGQNGLGDQISRLKLEVESMQSEESRLDELIRERQEALRSLEEDEYCKRYMFMTEEDITSIPRFQNQTLLAIKAPTASYIEVSDPDKVMSFPQRQYRMVIRSRMGPIDVYLLSKYKRDSGETSESDQNTQSGVDTPSLKIVTSDTDLKTDYWFESDAEVSLTDLWNNNFS

SEQ ID NO: 5199 - protein, 372 aa, Pisum sativum
MATPVEPPNGIRADGKHYYSMWQTLFEIDTKYVPIKPIGRGAYGIVCSSVNRETNEKVAIKKIQNAFENRVDALRTLRELKLLRHLHHENVIALKDIMMPVHRTSFKDVYLVYELMDTDLHQIIKSSQTLSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKRYIKSLPYSPGTPFSRLYPNAHPLAIDLLAKMLVFDPTKRISVTEALQHPFMASLYDPNCDPPAIIPIDLDIDEDLGEEMIRELMWREMVHYHPGSAMGNAELSS

SEQ ID NO: 5200 - protein, 353 aa, Coprinellus congregatus
MGCVQSTGVDDEAKARNDEIENQLKRDRVMAKNEIKMLLLGAGESGKSTVLKQMKLIHHGGYSDQEKDSYKEIIFSNTVQSMRAILDALPALDLALQPANDARRATILAVPGQIEAEVLPRDIADAIRQLWADPGLKEAVRRSREFQLNDSAVYYFNSIDRMSAPGYLPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPARRSTYFPDFTGGDNYDAACDYLLHRFVSLNQSAATKQIYAHYTCATDTQQIKFVLSAIQDILLQLHLRECGLL

SEQ ID NO: 5201 - protein, 341 aa, Arabidopsis thaliana
MFRSMLVRSSASAKQAVIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 5202 - protein, 428 aa, Pseudomonas syringae pv. syringae B728a
MAKIVDIKGREVLDSRGNPTVEADVLLDNGIIGSACAPSGASTGSREALELRDGDKSRYMGKGVLKAVANINGPIRDLLLGKDPVDQKALDHAMIELDGTENKASLGANAILAVSLAAAKAAAQDQDLPLYAHIANLNGTPGVYSMPVPMMNIINGGEHADNNIDIQEFMIQPVGAKSFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKILTDKIGEKTQLVGDDLFVTNTKILKEGIDKKIANSILIKFNQIGTLTETLEAIQMAKAAGYTAIISHRSGETEDSTIADLAVGTSAGQIKTGSLCRSDRVSKYNQLLRIEEQLGSKAVYRGRAEFRG

SEQ ID NO: 5203 - protein, 258 aa, Glycine max
MLSWKVLLVSAAVLFAALGLRVSLPVAATNLPLLWSFFLLCFKPPYLFVVLNAIIISIVASSRFHHSSNPQSPEPTPPRVESMPAPTVPEPPLFQVKAVLEVEKKVIEEDVVALKRKDSTEIPSPEEKPLVSARFTHRKFLKSSSEGGRALRVVAKAKRDETLESTWKAITEGRSMPLSRHMKKSDMWHNRNVTPQPQETFNDALSVSSGRLRKEPSLSQDELNRRVEAFIQKFNQEMRLQRQQSLEQYMQMINRGAA

SEQ ID NO: 5204 - protein, 492 aa, Avicennia marina
MDPYKYCPSSSFNTPHTTTNGGHPVYNDNSSLTVGTRGPVLLEDYQLIDKLAHFTRERIPERVVHARGATAKGFFEVTHDVSHLTCADFLRAPGVQTPLIVRFSTVIHERGSPETLRDPRGFAVKFYTREGNFDIVGNNFPVFFIRDAIKFPDVIHAFKPNPKSHIQESWRILDFCSHFPESLLTFAWFYDDVGIPQDYRHMEGFGVHSYTLINKAGKVNYVKFHWKPTCGVKCLMEDEAVRIGGTNHSHATQDLYDSIAAGNYPEWKLYFQIMDPDQEDRFDFDPLDTTKIWPEDIIPLIPVGRMVLNKNIDNFFAENEMLAFSPHMIVPGINFSNDKMLQTRIFAYGDTQRHRLGPNYLLLPVNAPKCAYHNNHYDGFMNFMHRDEEVDYFPSKYDPTRHAERHPIPNAVITGRRDRRVIEKEDNFKQAGDRYRSWAPDRQERFLRRWVDALSDPRLTLEIRSIWVSYWSQADKSFGQKLASRLNVRPTM

SEQ ID NO: 5205 - protein, 203 aa, Methanosarcina acetivorans C2A
MQGLVLYMNRKDGAVFLVFLLAGVLLISGCVKNERAETPADEQSETSNTGKGDENMDIQIIKVFSSAFESNGTIPRKYTCNGENINPPLEFTDIPEGTESLVLIMDDPDAPMNPFTHWIVWNIEPVAKIEEDSIPGIEGINNFREIGYGGPCPPSGTHRFFFRVYALDRQLELKAGAGRKELESEMIGHIIAEGELMGKYGET

SEQ ID NO: 5206 - protein, 500 aa, Schizosaccharomyces pombe
MTIDLNVIQSDIISARRAPENSLFIDGKFVSPIEPAAKPIPLINPATEEIIGTCANASAKDVDSAVENAYNTFRSGIWAKWPGKQRGLVLRKIAKMMREKRELLAGIDTINCGKPTPYALFDIDSCADMFEYYAEVAETDNPTVKVPLPNNPGFCAFEKRFPRGVIGVITPWNFPLKMALWKLVPAIASGNCVVLKPSELAPWSCLEFALICKEAGLPDGVLNVIIGSGKESGAALSCHPKIAYLAFTGSLATGKKIMHAAAENIVPLTLELGGKSPLIICEDADLSLAIPSAAFAIFFNQGEACTAASRLIVHESVADEVLGGLVSEANKLIIGNGLDPQVTLGPVVSKTQFEKIVSYIQSAINEGCKCVVGGLPRSEQKGYFIPPTVFTNVQTHNKIWREEIFGPVLAVKTFHTNEEALELANDSEYGLGSGVFSTNPKTLEFFSNNIEAGMCSLNNYHVVTHELPWIGWKHSGLGVGLSKHGYNEYMRLKQITQYVG

SEQ ID NO: 5207 - protein, 422 aa, Oryza sativa
MGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASFGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAERLLHGKRYCWWLRWLLVLAVGLSAMYVPNFTDFLALVGSSVCVLLGFVLPASFHLKVFGAEMSWSGVLSDVLLVLLGLSLAVFGTYTSLLQIFHSSSA

SEQ ID NO: 5208 - protein, 320 aa, Rhizobium etli
MKEHVMSHLKNKVAIVTGASSGIGAATARGLAEKGARVVLAGRNEERLSQIVEDITGSGGIASYKVADATDFESTKALVAFATTTYGPVDILVNNAGLMLFSYWKDAAVGDWNKMIDTNLRGYLHAIAAVLPSMLERRSGRILNMSSIAGVHVGEAAGVYGATKFFIRGITESLRKEVGVGSGIQVSMISPGVIDTGWADKVHDETGRKIAGELNKQGIPPSSVAEAVVYALDQPPEITINDISSIQPGRTGSPRFRELRTRTSGTVRPPRGTNRCRLSWLWTRRSSLHDDLIPDVFVFQRPGHLRRPSQDPTWITRSNF

SEQ ID NO: 5209 - protein, 69 aa, Glycine max
  unsure (1)..(69): unsure at all Xaa locations
CRNATSAVPAGASMVAPFTGLKYIAVLPTRNTILDFAYIASNGXRAQCMHVWPPIGKKKVETLSYLPDL

SEQ ID NO: 5210 - protein, 337 aa, Zea mays; identical to SEQ ID NO: 717

SEQ ID NO: 5211 - protein, 82 aa, Betula pendula
GFAWSWGPLSWLIPSEIFPMKIRSTGQSISVAVQFAATFVLSQTFLSMLCHFKFGTFLFYSGWIAIMTLFVALFLPETKGIN

SEQ ID NO: 5212 - protein, 506 aa, Pseudomonas fluorescens
MSQDPKKCPVTHLTTEAGAPVVDNQNSMTAGARGPLLAQDLWLNEKLANFVREVIPERRMHAKGSGAFGTFTVTNDITQYTRAKIFSEVGKKTEMFARFSTVAGERGAADAERDIRGFALKFYTEEGNWDLVGNNTPVFFLRDARKFPDLNKAVKRDPFSNKRSATNNWDFWTLLPEAFDQVTIVMSDRGIPAGYRHIDGFGSHTFSFINTQNERFWVKFHMRTQQGIQNLTDAEAADLIAKDRESSQTDLFDAIERGEYPKWKMYVQIMPELEAETVPYHPFDLTKVWPKGDYPLIEVGEFELNRNPENYFQDVEQAAFAPSNLVPGISYSPDRMLQARLVNYADAARYRVGVNHSQVPVNAARCPVNSNRRDGQGRMDGNYGSLPHYEPNSFNQWQEQPQFKEPALKITGDADFWDFREDDNDYFSQPRALFNLMNDEQKQALFNNTAAAMGDALDFIKYRHIRNCYACDPAYGQGVAKALGMTVADAQAARETDPAKGLPSFL

SEQ ID NO: 5213 - protein, 150 aa, Pectobacterium carotovorum subsp. carotovorum
  unsure (1)..(150): unsure at all Xaa locations
PGMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQXAG

SEQ ID NO: 5214 - protein, 300 aa, Zea mays
MGNARRPAADSAAASDREVGFAKLHGECFEYYMQTYSIVLGRHSRRRSKGPVAAPPEADDGVDVDLGALGAGMNVSRRHARIFYDFLRRRFALEVLGKNGCLVEGVHHVPGSAPVKLDSQDLLQMGDTKFYFLLPSRSVFDAGITRRSSAVQRAIPPPPSDDDEDEDEHEEAVAAAKRRRDGYNGSKSYREADDQLLLQLEEKDVISSAATILSDLCGPQEWISINKLHEVMFDKYGGMWHHSRVRKYLTSEDFAEAETDGRLWHGLALLLRKYPEHFVINIRKGGGLITEFVSLVSLQS

SEQ ID NO: 5215 - protein, 532 aa, Schizosaccharomyces pombe
NKLLFNRFASSQSKDSNISEMNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 5216 - protein, 404 aa, Neisseria meningitidis MC58
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 5217 - protein, 57 aa, Bacillus anthracis
MLITDDVLTTGRTIEAIIKLVEEAGGIISGIVFLVELTDLDGRKMLDGYDVLVLGID

SEQ ID NO: 5218 - protein, 469 aa, Gelidium latifolium
VIPYAKMGYWDPDYAVKETDVLALFRVTPQPGVDPVEASAAVAGESSTATWTVVWTDLLTACDLYRAKAYKVEAVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASSGIHCGQMHQLLDYLGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 5219 - protein, 124 aa, Triticum aestivum
LRRKKDQRLTMKQKCLVVLVFVVLLACAVGWDEGIPGGWNPIKNINDPHVTEIANFAVTEYDKQSGEKLKLVKVIKGDLQVVAGLNYRLSLTASDSNNYQAIVYEKAWAREHYRNLTSFTPLHA

SEQ ID NO: 5220 - protein, 427 aa, Glycine max
  unsure (1)..(427): unsure at all Xaa locations
MSLSVPKLARPLPLHHHSSYGSLTMSFHTFTPFLGSTHKLRFISPIKLNAPRFNSSVVSVSDLFKNNKPKSTTNLLITKEEGLQLYEDMVLGRSFEDMCAQMYYRGKMFGFVHLYNGQEAVSTGFIKLLKKEDSVVSTYRDHVHALSKGVPSREVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGXAFGMPGVHVDGMDVLKVREVAKEAVGRARRGEGPTLVECETYRFRGHSLADPDELRDPAEKEHYAGRDPITALKKYLFENNLANEQELKTIEKKIDEILEDAVEFADKSPLPPRSQLLENVFADPKGFGIGPDGSYRCEDPKFTQGTAHV

SEQ ID NO: 5221 - protein, 459 aa, Bacillus subtilis subsp. subtilis str. 168
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 5222 - protein, 335 aa, Bradyrhizobium japonicum USDA 110
MDAALGLPVLVGLIAVALLFDFLNGLHDAANSIATIVSTRVLRPQFAVFWAAFFNFVAFMVFGLHVAQTIGTGIIDPSIVDAHVIFAALVGAIVWNLVTWALGIPSSSSHALIGGLFGAGVAKAGISAAVWSGLSKTVIAIVLSPLVGFLLAMLLVAIVSWASVRSTPFAVDRAFRILQFASASLYSLGHGGNDAQKTMGIIAVLLYSQGHLGSEFSVPFWVVLSCQAAMAMGTLMGGWRIVRTMGLRITKLTPMQGFCAETGGAATLFMATFLGVPVSTTHTITGAIVGVGAARRLSAVRWNVASSIVYAWVITMPASAIVAALTWWAVRIFVK

SEQ ID NO: 5223 - protein, 207 aa, Brassica rapa subsp. pekinensis
WFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSK

SEQ ID NO: 5224 - protein, 564 aa, Arabidopsis thaliana
ESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTTEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 5225 - protein, 615 aa, Mesembryanthemum crystallinum
MMEWDSSSEESGDEEGFLLNDGGPVPFPVGNLIQTAPCGFTVTDALEPDHPIIYVNTVFEMVTGYRAEEVLGRNCRFLQCRGPFAKRRHPLVDSVVVAEIRRCLDDGVEFQGELLNFRKDGSPLMNRLRLTPIYGDDDTITHIIGIQLLSEANVDLGPLPSFPVKESTKSSDQYRSGLSLFPSFQSRERSICLEVCGLLQISDEVLALKIFSRLTPRDIAAVGSVCRRLYELTRNEDLWRMVCQNAWGTETTRVLETVPGAKRLGWGRLARELTTLEAAAWRKLTVGGAVEPSRCNFSACAVGNRVVLFGGEGVNMQPMNDTFVLDLNASNPEWQHVKVSSPPPGRWGHTLSCMNGSNLVVFGGCGTQGLLNDVFVLDLDAKQPTWREISGLAPPLPRSWHSSCTLDGTKLIVSGGCADSGVLLSDTFLLDIAMDKPVWREIPVTWSPPSRLGHTLSVYGGRKILMFGGLAKSGPLRFRSSDVYTMDLSEDDPCWRCVTGSAMPGAGNPGGVAPPPRLDHVAVSLPGGRILVFGGSVAGLHSASQLYLLDPTEEKPTWRILNVPGRPPSFAWGHSTCVVGGTRAIVLGGQTGEDWMLTDIHELSLASTVKEEDQL

SEQ ID NO: 5226 - protein, 337 aa, Zea mays; identical to SEQ ID NO: 2392

SEQ ID NO: 5227 - protein, 404 aa, Zea mays
  unsure (1)..(404): unsure at all Xaa locations
PPSGRPTLRSGLPAEFKHINKRRRRTYEDSPSNGERTGSSPPLQAAPRVQPFSAPAPIPIFSSKPRAAVRSPIPPPHLPAAVTSAPAPLAATAEAPSRPPPASTDQPPQQQTGAMPPPPAPAPGXKGGPKPKAQLNEQNSGEYSQSENNVVETAQGHDKETTPGPVKATKRIKKLKASKHNLNNTNSGAIEGDADPSLSSLNHCRYDSSLSLLTKKFINLLQGAEDGALDLNKAAETLEVQKRRIYDITNVLEGVHLIEKGLKNMVRWKGFDISKPKDIERQISSLKEELESLYDEELRLDDEIREAKEKLQALALDGDKRKSLYLLKEDINKIPHFQRSTMIAINAPRGTCVEVPDPNADQYMYGNLGLQEKHYKIVLRSSMGPVDCYLISGDHEDIFNQGQL

SEQ ID NO: 5228 - protein, 1023 aa, Neurospora crassa
MTRRDAEVKDRCDTGRESPSTDGTGKSIFHVKPPALAALRFLHLLHLALTCFASAATVTTPSLYRPIRGYRFQHLLSISHVPVQHFPEGIQSRIFVAATSGHTEQTQPGVFGCLQRLDHACLQGHAQPTRPDPTRTHHPDPPPTVHGSVKAPAVCNGIHSRRQNSEKTPLARGKDTDTHSDTLLHHGQAALETAIPRLPKPARQALPVSPWTVLMSGATAPRLQNVLSRPVLSSKRDAGRTSSHHLLKSLLLASRFAASTLVATTSSAGASRSTGTSSPDPGPTINKSQTNRNPSTYTSPPNSLSRTFSASNLLAWYRTLPSPYFNLSGHLDDLSSLIRPFLAFLDPSSLSSPYSMASTSYAFSTSSGSDFSTPRSSSPHSSASVASARSSHSSTFSAGKRLSMSSVRRTSASNPMSSVDLSTIEEALKMANLDTLKGYCQKTYGEVHQETTTEYISQEEARGYQVLNQPHWNKVADFRISPKGTSFTPEERVAKNLTGLIPHVMEDSEKQVERALKMIRTRQTDIDRYLYLSTIKSQNVDLFYRLLMDHAKEMMPLVYTPTIGDVCLQYSTLYTRPEALYISIKQRKSIRTILRNWPYPQPEICVVTDGSRILGLGDLGVNGVGIPIGKLALYTAAAGIHPDKTLPIVLDCGTANETNLKDPLYLGLRQKRIPVAEQQEFMDEFMEAAAEVFPDMVVQFEDFESEKAFNYLDRYRDQYKCFNDDIQGTGAVVLAGYIGAVNLSNVPIEEQRLVFMGAGSAGVGVAKQLVEYYTKRGLSEQQAKDKFWLVDTKGLVTKDRGDKLAEHKKYFARTDNNGHQFRTLEEVIEYVKPSALVGLTATHGVFTESVVRALKASVDAGGLGRRPILFPLSNPLTKAECTFKEAIDWTDGTVLFASGSPFSSYTTNGVTYHPNQGNNVYVFPGIGLGAILAKATRVTDDMIYTSAAALANSLNADEVKQGLIYPRIDRVREASVIVAREVMKSARREGVSTLPEEQWLEWEEWGDVDLERYIKQHIYDPKF

SEQ ID NO: 5229 - protein, 163 aa, Chloroflexus aurantiacus
MMSVLSGLIRPEIADLEAYTPIVPLEVLADRLGLPVAQIVKLDANENPYGPAPAALAALQATATYHIYPDPEQTALRKALADYTGRSAEEILCGAGADELIDLVLRLIISPGDAIIDCPPTFGMYRFDAGICGGRVISIPRRADFSLDLPAIARAAAQVPKPC

SEQ ID NO: 5230 - protein, 437 aa, Nostoc punctiforme
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 5231 - protein, 365 aa, Brucella melitensis
MQKPTRPQPKAGVLDIAAYVPGKEHVEGVAKVYKLSSNETPLGPSPHAREAYRHAGEKLELYPDGQALALRQAIAETQGLNISNILCGNGSDELLGLLCQTYLAPGDETIITEHGFAVYKIQTLAAGATPVTVKEKNERIDVDAILAGVTARTKIVFIANPANPTGTYLPFEEVRRLHAGLPQHVLLVLDAAYAEYVRRNDYEAGLELVSSNENVVMMRTFSKIHGLPGLRIGWIYAPLHIIDAMNRIRGPFNMNSAAIAAGAAAIRDRAHVEKSVAYNEKWLAWLTEEFTRLGLRVTPSVTNFLLIHFPDDAAHSADKADEWLSRRGYILRRVGGYGFPNALRMTVGPEEANRGVVAALTEFLK

SEQ ID NO: 5232 - protein, 231 aa, Zea mays
  unsure (1)..(231): unsure at all Xaa locations
MSSSTCGTREMLSANSTATSIGQVQKVPGFAKLQGENFGYFMQTYSMXLGRTSRRYTADFDLSKYECGSQCVSRCHACIFYDFELRHCAIEVLGRNGCTIRGVSYLPGSVPGKKKKIKLNSQDLIEIAGIKFYFLLPSRSIFATLAARDATMLPPQSPSLLHPNYPGNPSANDCGRSNGENGVKISNDMQGKLVKQKRSFSGELDISYSYGTKKNVDRVGTLDGCGMLSLL

SEQ ID NO: 5233 - protein, 342 aa, Synechocystis sp. PCC 6803
MVSERILPELNTAEISLDRETALVLYEDMVLGRFFEDKCAEMYYRGKMFGFVHLYNGQEAVSSGIIKAMRQDEDYVCSTYRDHVHALSAGVPAREVMAELFGKETGCSRGRGGSMHLFSSAHNLLGGFAFIGEGIPVALGAAFQTKYRREVLKDDGYDQVTACFFGDGTSNNGQFFECLNMAALWKLPILFVVENNKWAIGMAHERATSQPEIYKKASVFNMVGVEVDGMDVVAMHKVATEAVARARAGEGPTLIEALTYRFRGHSLADPDELRSAEEKQFWAARDPIKKFAAFMTEHELASNEELKAIDKRIQEVIDDALAFAESSPEPNPEDLRKYIFAD

SEQ ID NO: 5234 - protein, 439 aa, Oryza sativa
  unsure (1)..(439): unsure at all Xaa locations
MAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPXEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHVHLGSGKNEIFHPFDTDGTESVRFDCVCNRNRVIKLNSAQKKKKKKKNAERGG

SEQ ID NO: 5235 - protein, 281 aa, Cucumis melo
TLEDGMKVAVKRGNPRSEQGLAEFRTEIEMLSKLRHRHLVSLIGYCDERSEMILVYEYMANGPLRSHLYGTDLPPLSWKQRLDICIGAARGLHYLHTGAAQSIIHRDVKTTNILLDENFVAKVADFGLSKTGPSLDQTHVSTAVKGSFGYLDPEYFRRQQLTEKSDVYSFGVVLMEVLCTRPALNPVLPREQVNIAEWAMTWQKKGMLDHIMDPNLVGKVNPASLKKFGETAEKCLAEYGVDRPSMGDVLWNLEYALQLEETSSALMEPEDNSTNQSLPSN

SEQ ID NO: 5236 - protein, 307 aa, Streptomyces coelicolor A3(2)
MALGTASTRTDRARTVRDILATGKTTYSFEFSAPKTPKGERNLWSALRRVEAVAPDFVSVTYGAGGSTRAGTVRETQQIVADTTLTPVAHLTAVDHSVAELRNIIGQYADAGIRNMLAVRGDPPGDPNADWIAHPEGLTYAAELVRLIKESGDFCVGVAAFPEMHPRSADWDTDVTNFVDKCRAGADYAITQMFFQPDSYLRLRDRVAAAGCATPVIPEVMPVTSVKMLERLPKLSNASFPAELKERILTAKDDPAAVRSIGIEFATEFCARLLAEGVPGLHFITLNNSTATLEIYENLGLHHPPRA

SEQ ID NO: 5237 - protein, 495 aa, ASPERGILLUS NIDULANS FGSC A4
MKSLHQLARPRALPSFAAPRAQSARSNRLWQRCFSATRAASEGAQLDPSKLTITKTSTPKELLPAKDLVFGKNFTDHMFTVEWTAKDGWLAPQIVPYQKLQLDPSACVFHYAFECFEGMKAYKDSKGQIRLFRPDKNMQRLNKSSARIALPTVDGEALTKLIGELVKLDSRFIPDARGYSLYLRPTMIGTQSTLGVGPPGSALLFVIASPVGPYYPTGFKAISLEATDYAVRAWPGGVGDKKLGANYAPCIVPQLEAASRGFQQNLWLFGEEEYVTEVGTMNLFIALKNKETGKKELVTANLDGTILEGVTRDSVLALARERLVPKGWQVSERKIRMAEVAEAADEGRLLEVFGAGTAAIVSPVRTISYRGRLVNCGLKETEEAGEIASQMKNWIEGIQYGDEEHPWRIIYWQSIRFIFNSNPFLQSSLSDGRALVREKNYPTYLYSAPRVSSGFHQTPAHIIPCIIHLVEAELNQAQNMNPCQAVNKPALRDNQ

SEQ ID NO: 5238 - protein, 426 aa, Oryza sativa
MATDSSSSAAADKNTVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLAKDVAKNSTEDGNNSWPSSPVAASQPTNQADAIPDLKLAEASKEVANEKTEPEVIRSPRAPTHSFKKPIVAKKPGNKTGGLGARKLTSKPNESLYEQKPEELAPALPPVTENSTAKSKSHTSRFEYVENTPSAGSNSEENQVIGHVAPPKSSNFFGEFGMDSGYHKKSAPGPSKVQACYTPHKAFLLTNNWLLILIEESSEARQKFSNAKSISSSQFFGDQASFEKEAQVSLQKFSGSSAISSADLFGHPTNSSNVDLSASDLINRLSFQASQDLSSIKNMAGETGKKLTSLASNIMSDLQDRIL

SEQ ID NO: 5239 - protein, 422 aa, Pseudomonas aeruginosa PAO1
MSLIADHGFAFLVLACLFGFFMAWGVGANDVANAMGTSVGSRALTIRQAILVAMVFEFCGAYFAGGEVTETIRSGIVDPQYMTPDLLVFGMLSALLAAGVWLLLATIKGWPVSTTHSIVGAIIGFASVGVSVHAVHWGAIGPIVASWVVTPVLSGLLAFALFRSVQWLVLHAEDPFRSARRYVPLYMFLAGFMVALMTVGKGLKHVGLELSGLQTLGLALLAGGLVMGLGIVLLLRIRPTGGADPRGGFASVERVFAVLMIFTACSMAFAHGANDVANAIGPVAAVVAVVQAGGDLDLVSRSPVPSWVLLLGAVGIVIGLATYGYRVIATIGREITELTPSRGFAAELATASTVVGASAIGLPVSTTHTLVGAVLGIGMARGIGALNLRVIGSIFLSWVVTLPAGAVLAILFFLVLRALFGA

SEQ ID NO: 5240 - protein, 184 aa, Physcomitrella patens subsp. patens
MASAVASTVVAPVSVTVASSSVAASRESSSVKAFSGLKSATLFTSKSQQLSSVQNGSRVQCMQVWNPIGQPKFETFSYLPPLSDDQIARQVDYMIQQNLIPCIEFDTVGAVSRTNFSGSGSSGYYDGRYWTMWKLPMFGCTDSSQVLREIQECKTSYPSCWVRVLGFDSKKQVQICGFLVARPN

SEQ ID NO: 5241 - protein, 101 aa, Cucumis sativus
HIQENWRILDFFSHHPESMNMFTFLFDDIGIPQDYRHMDGSGVNTYTLINKAGKAHYVKFHWRPTCGVKSLLEEDAIRVGGSNHSHATQDLYDSIAVETYP

SEQ ID NO: 5242 - protein, 593 aa, Saccharomyces castellii
MPRNVIQPNKEKTVDYSSTEYLPNELESPSFNLDATEESRSGLVHRFVDSFKRAQDSTENDLEDGTKPLGDASHLKKAMKSRHVIMMCVGTGIGTGLLVANASGLSYGGPGSLVIGYVLVSFVTYFMIQAAGEMAVAYPTLPGNFNSYTSMFISKPFGFATVWLFFIQWLTVFPLELITASLTIKYWNDKINADVFIVIFYVFLLFIHFFGVKAYGEAEFIFNSCKVLMIAGFIILSIVINCGGAGKDGYIGAKYWRDPGSFAEGDSVEKFKGICYILVTAYFSYGGAELFSLSVNEQENPRKSTPQAAKQSIYRILIIYLLTMILIGFNVPHNNDQLMGSGGSATHASPYVLAASIHGVKVVPHFINAVILISVISVANSALYASPRLMCSLAEQGYAPKFLDYVDREGRPLRALILCAVFGVIGFVSASSKEEEVFTWLAAIAGLSELFTWSGIMLSHVRFRQCMKLHGRSEEEIGFRAVTGIWGSMYGISFNMLVFIAQFWVALAPPSLHGKVDAESFFQSYLAAPIWLFFYFGYMLYKRDFTFLVPLDKIDLNFHRRIYDPELIRQEDEENKEKIKNSSVWVRMFHFWC

SEQ ID NO: 5243 - protein, 632 aa, Schizosaccharomyces pombe
MSIDCLYRRSSLFDTSFVPLHSSIPATSKMSASNSDVNAPISPVVDEGKSELVSPTLERLVAPFNCSPSSTPLQDVAGVGSKMSDTLWMGDLEPWMDATFIQQLWASLNEPVNVKVMRSKASSSETLISYCFVQFSSSAAAERALMKYNNTMIPGAHCTFKLNWATGGGIQHNNFVSRDPEFSIFVGDLLPTTEDSDLFMTFRSIYPSCTSAKIIVDPVTGLSRKYGFVRFSSEKEQQHALMHMQGYLCQGRPLRISVASPKSRASIAADSALGIVPTSTSNRQPNQDLCSMDPLNTTVFVGGLASNLSEKDLQVCFQPFGRILNIKIPFGKGCGFVQYSEKSAAEKAINTMQGALVGTSHIRLAWGHNTLPVSALSQSQSQVSDEGFDRTLSANQIFGMNQSVIGANSGSSNSSGSSLKSAPVSPRTAAAQSLLPNSVVSSINGMNSVNFSTISPPPLSRSASISPTLSGSGSGLTPLSSHFPSAATGLVGGQVYPQSSVLQSSKINGSAKVQPSVKLPEWLQPFSGNNHNSFATQDLLTRVSSLKLVDDEQPASLNGSAFQARASRPWNLGRERQSSLIDLRHELEQNENGLEKSGFGLNLRGRLPPRSYSTFNCTGQYLQPSLRLSRDS

SEQ ID NO: 5244 - protein, 411 aa, Shigella flexneri 2a str. 301
MEFTTGLMSLDTALNEMLSRVTPLTTQETLPLVQCFGRILASDVVSPLDVPGFDNSAMDGYAVRLADIASGQPLPVAGKSFAGQPYHGEWPAGTCIRIMTGAPVPEGCEAVVMQEQTEQTDNGVRFTAEVRSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKMILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERDRGNVDVREWVEVEPFNALFGGL

SEQ ID NO: 5245 - protein, 353 aa, Zea mays
MRQISSLLQGLARSLSVGRDRDRDRDRKGNGAGDRKTAVPAVLRTSGTLWGDGSDTFAAVCSRRGEKGINQDCSIVWEGFGCQEGTIFCGIFDGHGQWGHYVAKAVRDSLPPSLLCHWQEALALASLIDDGEKKLGDCQFDLWKRSYVAACAAVDDELRRSRRLDAVQSGCTALSIVKQGDLMIVANVGDSRAVLGTTSGDGAIAAVQLTVDLKPNLPQEKERIRRCNGQVYCLADEPGVHRVWQPSRESPGLAMSRAFGDYCVKDCGVISTPEVTQKRISSSDQFIILATDGVWDVLSNDEAVHIVAGTPDRAKAAKRLVECAVRAWRRKRRDIAVDDCSAICLFFHPPPPS

SEQ ID NO: 5246 - protein, 549 aa, Methanosarcina acetivorans C2A
MATIGYFSMEIGLRNEIPTYAGGLGVLAGDTIRSASDLKIPLVAVTLVSNKGYFRQSLDVMGNQTEKIEEWTPSSFMTRTPQEVSVKIQDREVKIQAWQYNCKSLTGGCVPIIFLDTNVEGNAWEDRGITDFLYGGDHTYRLKQEIVLGIGGVRMLNALGFKVRKYHMNEGHSSLLALELLKCNNKDATKVKDLCIFTTHTPVEAGHDKFDYRLVDDLIRDKNDVEILRRFGGEDRFDTSLFALNLSNYVNGVTKRHSRVSSELFPGYSIQAITNGVHSYTWTSPFFRKLFDHYLPGWANEPELLVRIGGIPDDEIWQARRNAKKALIDEVNKRTGAGMDYETLTIGFARRMAEYKRATLILSDLERLRKINRRGRIQLIFAGKSHPNDGAGKQLIRDIFRSIETLRNEIKIVFLENYDMELAAKMVSGVDVWLNTPTRPYEASGTSGMKAAHNGVVNFSVLDGWWIEGWIEGVTGWSIGPKPEEHLSGEEARLAELDDLYNKLYYIIVPTYYERRDEWFKLINNSIGMIAYYFNSHRMMRRYVTHAYL

SEQ ID NO: 5247 - protein, 396 aa, Pseudomonas amyloderamosa
MANTKVADVVTETLHVAGVKRIYGVVGDSLNGITDSLRRRGDIDWIHVRHEESAAFAAGAEAHLTGELAVCAGSCGPGNLHLINGLFDCHRSRVPVLAIAAHIPSAEIGRGYFQETHPESLFRECSHYCELVSSPEQLPGVLESAIRAAVGLRGVAVVIIPGDVALRESNAKPAAGASMALRPPVVQPAAADVDALAQLLNDSGKVTLLCGRGCAGAHDPLVKLAEALKAPIVHAFGGKEYVEYDNPYDVGMTGLIGFSSGYHAMLNCDTLLMLGTDFPYRQFYPADAKIAQVDVRPENLGRRARLDLGMVGDVSATIGALLPKLKARTDRAYLDACLAHYRKAREGLDELPPASRDASPFTHNTWPSWSARQRRTMRFSRSTWARRRSGPRVISP

SEQ ID NO: 5248 - protein, 331 aa, Beta vulgaris
MAELNNGGHSKELVVSFGEMLIDFVPTSSGVSLAEAPGFLKAPGGAPANVAIAVSRLGGNAAFVGKLGDDEFGHMLAGILKKNGVSADGLSFDKGARTALAFVTLKSDGEREFMFYRNPSADMLLTPDELNLDLIRSAKVFHYGSIRLIVEPCRSAHLKAMEEAKKAGALLSYDPNLRLPLWPSAEEAREQIMSIWDKAEVIKVSDNELEFLTGNSTIDDATAMSLWHPNLKLLLVTLGDQGCRYYTKNFKGSLDGFKVNAVDTTGAGDSFVGALLNKIVDDHSIIEDESRLKEVLKFANACGAITTTKKGAIPALPTVADALELIKKNAS

SEQ ID NO: 5249 - protein, 218 aa, Streptococcus pneumoniae R6
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTPVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 5250 - protein, 745 aa, Cytophaga hutchinsonii
MKHLYFFTGIFFLSVTCVAQTDSIENKIHALVKKMSLDEKIGQTCLKGTSSRSKGLSEELKEQVRKGLVGAILNLTDTALVLQIQRIAVEESPNHIPLLFGRDVIHGYKTIFPIPLGLAASWDSVLVEKTAMIAAQESYSRCINWTFAPMVDICRDARWGRIAESPGEDPYLASVLARAYINGFQGNNPAQPGRILACSKHFAAYGAAEGGRDYNTVSMSRSTLWNMYLKPFHASVQAGAATFMTSFNDLNGVPASGNAYLLKDVLRNQWKFPGFVVSDWNSVTEMITHGYCTDEKDAALKAFSAGLDMEMTSQAYAHHLKTLIAEKKITEQQLDELVKNILRIKLYAGIFENPYFKEKEKFTLLDSAALTLAKKSAVKSFVLLKNHNNTLPLAATKKIAVIGPLAEAPKEQLGTWIFDGDKTNSQTPLAALKKMYGAENIKYVQGLTHSRDESHDDFNAAYKAAKKSDVVLFFAGEEAILSGEAHSRADIRLPGAQERLIRKLHKAGKPIVLVIMAGRPITIEHILPNVSAVVMAWHPGTMAGPALADVLSGKENFSGRLPVTWPKTVGQIPIYYNHTNTGRPADSVSFVGIKDIPIEAWQSSLGNNSHYLDAGYTPQYPFGYGLSYTKFVCTNSSIEKNTLTVKDSLIVTLSVSNAGSRSGIETIQLYVQDVTASLVRPVRELKAFAQVELKAGETKTVRFAVAVSELGFYNNEGIYVIEPGAFNLWVAQDAAGGMKQSFEIK

SEQ ID NO: 5251 - protein, 454 aa, Hypnea cornuta
GYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIKGFYNTLLLPYLKINLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 5252 - protein, 317 aa, Coleochaete scutata
NGFGRIGRNFLRCWYEREDSPIEVVAINDSGGVKNAAHLLKYDSMLGTFKAEVKAIDDKTLSVGGKPITVVSNRDPLKLPWADLGIDIVIEGTGVFIDGPGAGKHIQAGAKKVIITAPAKGADIPTYVVGVNADDYDHDVANIISNASCTTNCLAPFVKIMDAEFGIVKGTMTTTHSYTGDQRLLDASHRDLRRARAAALNIVPTSTGAAKAVALVLPQLKGKLNGIALRVPTPNVSVVDLVVNTVKKGFTAEDVNTAFRNAANGSLKGILGVSDLPLVSIDFRCSDESSTIDSSLTMVMGDDMLKVVAWYDNEWGY

SEQ ID NO: 5253 - protein, 360 aa, Oryza sativa
MGNDEAVVTQKMGKAPSPPKDHPALSPYLDWSNMQAYYGPGILPPTFFSPGIAAGHTPPPFILGPQPLVPSAFGKPYAAIYPPGGAFSHPFMPLMVSPLSMEPAKSVNSKDSCSNKKMKEIDGATVSTGSGNSEKTSGDCSLEGSSDGNNQKASGTPKKRSIDDRPKSGVETGGALTPNDRPSEQAALPNLCIPVTAIKPDVSTASDFRVIATPVTEVPTKDDKESKRERRKQSNRESARRSRLRKQAETEELARKVELLTAENTSLRREISRLTESSKKLRLENSALMEKLTETGPDEAQEVPPVKTKAQQARGVENFLSMIDKTGTPRSSGHMDHAIATPKLRQLLGSGLATDAVAAR

SEQ ID NO: 5254 - protein, 145 aa, Triticum aestivum
  unsure (1)..(145): unsure at all Xaa locations
MASTATCEAPMQGLKYTDGLPVSRRSNSASLGSDSNGGRIRSMQEWPIEGIKKFETLSYLPPISTEALLKQVXDYXRSSSKWERCLDDSKAGHMTREHNASRGYYKRRNWTMWKLPMIGSTDATQVINEDEEGKKENPDANVRII

SEQ ID NO: 5255 - protein, 546 aa, Schizosaccharomyces pombe
MGKNLTIVMLVFVSMAGWMFGADTGSIGGITNMRDFQSRFADRYNPVTDSYSYSSARQGLITGMVNVGSFFGCFLSSPLMDRIGKRTSIMFWTIVYLIGIILQVTAVPSWVQIMVAKIWTGLSIGALSVLAPGFQSEVAPADLRGTIVTTYQLAVTGGIFIAACINMGTHKLHKTAQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDAVNFGCTFGGLFVLEFFGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFAHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 5256 - protein, 479 aa, Zea mays
MSVQEYLEKHLLSRKIEEAVNAAVRAKAPDPVLFIAGHMRRAAPAVITRVRARQILDGHGAPAVEVELHTNKAIHRASAAGSGALEGAAADAAGAAERRKILAKVVADSVRMINDKVSEALVGMDPQEQSQIDQAIMDLNKARHKAELGVGANAMLAVSIAACKAGAAEKEVPLYKHIANLVGKSATTLPVPAITVINGGKHAGNGLPIQEIMILPIGAKNFEEAMQMGSETYHHLKDVILEKYGSDSCNIGDHGGFAPNISSISEGLDLVIAAIERAGYNGRIKLAIDVAATDFCTGKKYDLEFKSTKKSGQNFKTADDMIEIYSQLCSEYPLVSIEQPFDKDDWEHSKKLTTLELCQVAGDDLLMSDPERIKRAVNEYTCNALVLKANQVGTVTEAIEVVKQAKDAHWGVMVSHRSGDTEDSFIADLAVGASAGQIKAGAPCRGECLTNYNQLLRIEGELGSEGVYAGENWRTVNTS

SEQ ID NO: 5257 - protein, 601 aa, Haemophilus somnus 2336
MVAEGANPLVSVVTLLAAAVVAVPLFKRLGLGSVLGYLAAGLVIGPFGFGLFTDPEGIIHIAELGVVMFLFIIGLEMKPSHIWGLRNYIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGTAFAVLVAAGLWLLNPLFKMLAKTKTREVMTAAALLVVLGSALLMEEGGFSMAMGAFLAGVLLSESSFRHQLEADIEPFRGLLLGLFFLGVGMSLNLSVVAENWFLIIFGVLLFMLVKGFIIYLIALITKTGNANSIDRAFIMAQGGEFAFVLFSAAASQNVISEEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIIAIDNREQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 5258 - protein, 510 aa, Zea mays
  unsure (1)..(510): unsure at all Xaa locations
HGVALASESVVPAGAPCRRQEASSASCAPTAPTNPPVRGSWAQCRRRPLGQQRRTPAAAASAPSGASQGRAALLLLRRLSCDEEPESGFAAGDQQAVDFPGGKVSFVAEMNFLPESTRERINCYRVLDDDGRTISGSRFQEVSRELALKMYSEMVTLQIMDTIFYEAQRQGRISFYLTSNGEEAINIASAAALSMDDIVLPQYREPGVLLWRGFTLQEFANQCFGNQXDYGKGRQMPIHYGSNRLNYFTVSSPIATQLPHAVGAAYSLKMDKKDACAITYFGDGGTSEGDFHAALNFAAVMEAPVIFFCRNNGWAISTPTTEQFRSDGVVIRGQAYGIRGIRVDGNDALAVYSAIHAAREMAVTEGRPILVEALTYRVGHHSTSDDSTKYRPVDEIEHWRTARDPISRYRKWVQGNDWWSDAEESELRSRVRKELLQAIQVAERMPKPPVTELFTDVYDKIPSNLHEQEQLLRDTIMRHPADYPTDVPVGVVLRYAEGLTRRSSFGQSRF

SEQ ID NO: 5259 - protein, 212 aa, Triticum aestivum
MAGIRWPPEDPEIFPSRMVSGGAWIPVAPPGEMASDDDRSVAADSWSIKSDYGSTLDDDQRYADTAEVLLASSSASSAAAPSASVAVHPSSDFSFDKDVPDSSDVEPRLLGLQNFQDGAYAEDLANFHERSHADDWFGTEIMDIRVGWTKNLCSSRDLPSCSVLDIGTGSGRLLQQLAKQGFSDLTGIDYSEGAIELARNLAIRDGFEHINF

SEQ ID NO: 5260 - protein, 137 aa, Triticum aestivum
  unsure (1)..(137): unsure at all Xaa locations
QPALPLGRKHPTAAAKRHRDLFDGRCQPGIPFGRLCGNCDGXCVICDSYVRLCTVVRRCDEWHGRLVQQRGLVAGEVGLREPHYRQDCERQERDLQRGQKVGKVGWAEAHVVSECWMPSFERREFVYLDLAGIPGIP

SEQ ID NO: 5261 - protein, 208 aa, Phytolacca americana
KRRNGLLKKAYELSVLCDAEVALVVFSSRGRLYEYANHSVKGTIERYKKACSDQSGAGSVAEANAQYYQQDSAKLRNQIRTITENNRLLSRHMMGEGLSSLTMKELKNLEGKLERGISRIRSKKNELLFAEIEFMQKREIELHNNNQFLRARIAENERAQQSMSLMPGGGDYELVPSQSFDSRNYFQVNALQPNNQYSRQDQTPLQLV

SEQ ID NO: 5262 - protein, 500 aa, Glycine max
  unsure (1)..(500): unsure at all Xaa locations
MATPTAYQEHLPASPHWLNKGDNAWQLTAATLVGLQSMPGLVILYASMVKKKWAVNSAFMALYAFAAVLICWVLVCHRMAFGDKLLPFWGKGAPALGQKFLTHRAKVPESTHYYNNGTVESATSEPLFATASLVYFQFTFAAITLILLAGSVLGRMNIKAWMAFVPLWLIFSYTVGAFSLWGGGFLYHWGVIDYSGGYVIHLSSGIAGFTAAYWVGPRLKSDRERFPPNNVLLMLAGAGLLWMGWSGFNGGAPYAANIDSSIAVLNTNICAATSLLVWTSLDVIFFGKPSVIGAVQGMMTGLVCITPGAGLVQSWAAIVMGILSGSIPWVTMMILHKKSSLLQKVDDTLGVFHTHAVAGLLGGLLTGLLAEPALCRLLLPVTNSRGAFYGGGGGMQFFKQLVAAMFVIGWNLVSTTIILLVIKLFIPLRMPDEQLEIGDDAVHGEEAYALWGDGEKYDPTRHGSLQSGNTFVSPYVNGARGXDHKLMSQEIRLCFAHTYV

SEQ ID NO: 5263 - protein, 548 aa, Thermosynechococcus elongatus BP-1
MLVTASTSRPSRWLLFRRISQIVGVLGQFGTQLLWDYTWRRRSDRAQSQRARWLVQQLLVLGPTFIKIGQFLSTRFDLLPPAYIEALRKLQDQVPPFDSRRAIALIEEHLGQSLGDLYATFDPKPLAAASLGQVHRARLHSGEEVVVKVQRPQLEAQLYLDYLAIGELIRWGDRWLPFLRAYGLQEIYEEFFSILLREIDYVQEGQNADRFRANFAQDPHIRVPKVYWTHTCRYVLTMEYLPGIRIDNRAAIEAFGLNPQIINQRGICCYLKQLLMDGFFHADPHPGNLAVTKEGDLIFYDYGMMTEVPALNQQQMVRTFFAVLQKDSDRVIAALMELGLLLPVTDRAPLQRIMQLILDRFTERPVDLAAFKELQQDVYALFEQQPFRLPAKMTYILKSLTTLDGIARSLDPEYNLSAAAQPFVKELMRHSRPGWRELIHQTQTLINQRRQQPSRVEVRLQQLEDRLARGELQVSVRYPTMERQLRRLESLLICLVYLGLAGFTLLAGAMLWSAKAPGGAIALFTVAALAGLALLRSWLRFLWLCRWQ

SEQ ID NO: 5264 - protein, 367 aa, Mycobacterium tuberculosis H37Rv
MGEGSRRPSGMLMSVDLEPVQLVGPDGTPTAERRYHRDLPEETLRWLYEMMVVTRELDTEFVNLQRQGELALYTPCRGQEAAQVGAAACLRKTDWLFPQYRELGVYLVRGIPPGHVGVAWRGTWHGGLQFTTKCCAPMSVPIGTQTLHAVGAAMAAQRLDEDSVTVAFLGDGATSEGDVHEALNFAAVFTTPCVFYVQNNQWAISMPVSRQTAAPSIAHKAIGYGMPGIRVDGNDVLACYAVMAEAAARARAGDGPTLIEAVTYRLGPHTTADDPTRYRSQEEVDRWATLDPIPRYRTYLQDQGLWSQRLEEQVTARAKHVRSELRDAVFDAPDFDVDEVFTTVYAEITPGLQAQREQLRAELARTD

SEQ ID NO: 5265 - protein, 446 aa, Glycine max
MGQGTPGGLNRQGLPGDRKPDGGDKKEKKFEPAAPPARVGRKQRKQKGPEAAARLPTVTPLSKCKLRLLKLERIKDYLLMEEEFVANQERLKPQEEKAEEDRSKVDDLRGSPMSVGNLEELIDESHAIVSSSVGPEYYVGILSFVDKDQLEPGCAILMHNKVLSVVGLLQDEVDPMVSVMKVEKAPLESYADIGGLDAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 5266 - protein, 80 aa, Zea mays
  unsure (1)..(80): unsure at all Xaa locations
MDPYMHAASNESNYSXWTTNSGARVWNNNYVLTVGQRRAILLEDYHLIEKLAHVHRQRIPERVVHAQXDSANGFFEGTHD

SEQ ID NO: 5267 - protein, 130 aa, Streptococcus thermophilus
AGCSSLVTQLFFDNERFYDFQDKCTLAGIDVPIYAGIMPILNRNQALRLLKTCENIHLPRKFRAILDKYEHDPESLRAAGLAYAVDQIVDLVTQDVAGVHLYTMNNAETARHIYEATHSLFKHHSQVGAL

SEQ ID NO: 5268 - protein, 260 aa, Zea mays
MAHHRRRLLHSPSIHLPPHPAAALLFSPPEPDWNLPERGYKGTRIEETNPFHSIPHKARHKRTKPMASDGSGVVTVYGSNGAELLEPSKQPKSATFSVKVGLAQMLRGGVIMDVVTPEQARLAEEAGACAVMALERRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDL

SEQ ID NO: 5269 - protein, 485 aa, Eremothecium gossypii
MARVTVLGAAGGIGQPLSLLLKTCSLVSELNLYDLRNAPGVAADVSHVNTDCRVAGFEGPAELGRALRGADLVVIPAGVPRKPGMTRDDLFGINAGIVQSLVTAVAKHCPAARLLIISNPVNSTVPIAVETLKRLGKLNAARVFGVTTLDLVRAQSFLADALGRDAHRVADLASHVTVVGGHAGRTIVPLLADAQLRELQRRGLYDSYVHRVQFGGDEVVKAKAGAGSATLSMALAGFHFAELLLRSLAGEAVAPEPAFVYLPGLPGGADLARALAATEPVDYFAAPVRLAAGDAAVVDTAFVADLAPEQRALVDAALPELAASIRKGVDFVHAPRPAFSRRLYIAPVSSAPPSHIRVVLTAFFAGRTTRARPRSPLFRPPFARPNGTAWARGLQADTQGMRLAPQAVIIVNQSAPRYRYSLTIKRVVVHTHTTGRLLLFTFAYYTPKRALPAQDGPRQARITSSRRPTTARLRLLGGHRVYTAL

SEQ ID NO: 5270 - protein, 308 aa, Streptomyces avermitilis MA-4680
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 5271 - protein, 359 aa, Salmonella typhimurium
MSKNYHIAVLPGDGIGPEVMAQALKVMDAVRVLICVYHSHYDVGGIAIDSSGIPLPKATVEGCEQADAILFGSVGGPKMGKFAPGKPAGARRLLPLRKHFKLFSNLRPAKLYQGLEAFCPLRADIAANGFDILCVRELTGGIYFGQPKGREGSGQYEKAFDTEVYHRFEIERIARIAFESARKRRCKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRTADANDAATAIEQAINRALEEGVRTGDLARGAAVSTDEMGDIIARYVAEGV

SEQ ID NO: 5272 - protein, 131 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 5273 - protein, 91 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDP

SEQ ID NO: 5274 - protein, 208 aa, Glycine max
MALHCGTFCFWTVASHPPSSVKLSQPTIKASSFSSPLAPPLVKLNVRGKAFPGDGTPETKESPLVVCFGEMLIDFVPTVNGLSLAEAPAFKKAAGGAPANVAVGISRLGGSSAFIGKVGEDEFGYMLANILKENNVNNEGMRFDPGARTALAFVTLRSDGEREFMFYRNPSADMLLQEDELEFDLIRKVKTKAEFVVVKLKQNVCHTP

SEQ ID NO: 5275 - protein, 292 aa, Buchnera aphidicola str. Sg (Schizaphis graminum)
MNFLHQYYQDIIKKKLENLNDKIQCSFEFFPPKNLDTEKKLFSSVVKLSLLKPFLFSVTYGANSGERKKTYSIVQRIHKKTGITTAPHLTCVDASLSELKEIAKFYWENGIRSIVALRGDVPNKSYQHKIYALDLVVLLKKIADFDISVAAYPEIHPESKNAQSDILNLKKKADAGANRAITQFFFNVESYLRFRDNCIKNNINIEIIPGILPIYNFEQLKKFSSMTNVSIPKWMFEMFNGLDEDLETQKIIGSNIVINIVKTLLYEGVKNFHFYTLNKSDVIYSICHMFGL

SEQ ID NO: 5276 - protein, 789 aa, Glycine max
  unsure (1)..(789): unsure at all Xaa locations
MQQSDQTVLSLRPGGGRGSRLLAPRFDSSSSSSASPAFGSFSADLPLLRPHAGAPSPFSIKAGDARFEGRERVRYTREQLLQLKEGVEILDDVLKIKQDIEAELFGEDQSWARPENNPTQQFQNRYTEPDNRDWRGRSGQLSGNADERSWDNLKENREFGNTSNRQDQLNSQFARTQISSNQGGGPTPTLVKAEVPWSARRGTLSDKDRVLKTVKGILNKLTPEKFDLLKGQLIDSGITSADILKGVISLIFDKAVLEPTFCPMYAQLCSDLNEKLPPFPSDEPGGKEITFKRVLLNICQEAFEGADKLREELRQMTAPDQEMERRDKERLVKIRTLGNIRLIGELLKQKMVPEKIVHHIVQELLGPPDIKVCPAEENVEAICQFFNTIGKQLDESPKSRRINDMYFIRLKELSTNPQLAPRLRFMVRDVLDLRSNNWIPRREEVKAKTITEIHSEAEKNLGLRPGATASMRXNRVXPGALGNTSPGGFPIARPGTGGLMPGMPGTRRMPGMPGIDNDNWEMPKTRSMPRGDMSGMQTGGHSQSPFLSKTSTVNSRLLPQGSGGIISGRSSALVHGAGAPSAARPPNLGFSAEPTPQIPSPVKAVSAIPAEKPQPPAAKLNFDELQRKTVSLLEEYFNVRLLDEALQCVEELKAPAYYPEFVKEAISLALDKSPPCAEPVANLFEYLFIKKILSARDIGTGCMLFASLLDDIGIDLPKAPNNFGEIIGKLVLAGGLDFKVVTEILKKVEDDRFQKAIFSSALQVITSASGQAVLDAQASDIEACQSLFN

SEQ ID NO: 5277 - protein, 178 aa, Glycine max
  unsure (1)..(178): unsure at all Xaa locations
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 5278 - protein, 713 aa, Paenibacillus macerans
MKKQVKWLTSVSMSVGIALGAALPVWASPDTSVNNKLNFSTDTVYQIVTDRFVDGNSANNPTGAAFSSDHSNLKLYFGGDWQGITNKINDGYLTGMGITALWISQPVENITAVINYSGVNNTAYHGYWPRDFKKTNAAFGSFTDFSNLIAAAHSHNIKVVMDFAPNHTNPASSTDPSFAENGALYNNGTLLGKYSNDTAGLFHHNGGTDFSTTESGIYKNLYDLADINQNNNTIDSYLKESIQLWLNLGVDGIRFDAVKHMPQGWQKSYVSSIYSSANPVFTFGEWFLGPDEMTQDNINFANQSGMHLLDFAFAQEIREVFRDKSETMTDLNSVISSTGSSYNYINNMVTFIDNHDMDRFQQAGASTRPTEQALAVTLTSRGVPAIYYGTEQYMTGNGDPNNRGMMTGFDTNKTAYKVIKALAPLRKSNPALAYGSTTQRWVNSDVYVYERKFGSNVALVAVNRSSTTAYPISGALTALPNGTYTDVLGGLLNGNSITVNGGTVSNFTLAAGGTAVWQYTTTESSPIIGNVGPTMGKPGNTITIDGRGFGTTKNKVTFGTTAVTGANIVSWEDTEIKVKVPNVAAGNTAVTVTNAAGTTSAAFNNFNVLTADQVTVRFKVNNATTALGQNVYLTGNVAELGNWTAANAIGPMYNQVEASYPTWYFDVSVPANTALQFKFIKVNGSTVTWEGGNNHTFTSPSSGVATVTVDWQN

SEQ ID NO: 5279 - protein, 116 aa, Glycine max
SARGSCCHTINLVPVLESNQVIHCTNCRTTLMYPYGASSVKCAICRYITNVSMTNGRLPIPVQRPNGTANSGTVSSTSSSMPHSQSQTVVVENPMSVDSSGKLVSNVVVGVTTEKK

SEQ ID NO: 5280 - protein, 338 aa, Zea mays
  unsure (1)..(338): unsure at all Xaa locations
MGKIKIGINGFGRIGRLVARVALQSEDVELVVVNDPFITTDYMTYMFKYDTVHGQWKHSDIALKDSKTLLFGEKPVTVFGIRNPEEIPWGEAGAEYVVESTGVFTDKDKAAAHLKGGAXKKVDISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 5281 - protein, 362 aa, Xanthomonas campestris pv. campestris str. ATCC 33913
MSVAAQFEIEYLQYMDADGQLVRDDLPADAANPQQLLALFKRMLFVRTFDSKSIALQRTGKLGTYAASLGHEATHVGIGASMRSGDVFAPSYREYGTMFERGVRPRDVLLYWGGDERGSDYPRDADAAIDFPICVPISTQCLHAAGAALSFKLQGKAQVAVACCGDGGSSKTDFYAALNSAGAYTLPLILCVINNGWAISVPRSAQTGAQTLAQKGLAGGLHCLQVDGNDLIAVLEAMRQARARALAGDGGTVIEFLTYRLTDHTTADDARRYRGEDEVKQAWTREPMLRLRRYLTAQGLWDEAQEEAWKAECGARIDEEVNAYLNTPVQPVEAMFDYLYGDPPAELLAQRAEVIALEARHG

SEQ ID NO: 5282 - protein, 353 aa, Zea mays
MRQISSLLQGLARSLSVGRDRDRDRDRKGNGAGDRKTAVPAVLRTSGTLWGDGSDTFAAVCSRRGEKGINQDCSIVWEGFGCQEGTIFCGIFDGHGQWGHYVAKAVRDSLPPSLLCHWQEALALASLIDDGEKKLGDCQFDLWKRSYVAACAAVDDELRRSRRLDAVQSGCTALSIVKQGDLMIVANVGDSRAVLGTTSDDGAIAAVQLTVDLKPNLPQEKERIRRCNGQVYCLADEPGVHRVWQPSRESPGLAMSRAFGDYCVKDCGVISTPEVTQKRISSSDQFIILATDGVWDVLSNDEAVHIVAGTPDRAKAAKRLVECAVRAWRRKRRDIAVDDCSAICLFFHPPPPS

SEQ ID NO: 5283 - protein, 129 aa, Pseudomonas alcaligenes
CIGCHTCPVTCKNVWTSREGMEYAWFNNVETKPGIGYPKEWENQETWKGGWVRNKDGSINPKIGGKFRVLANIFSNPDLPSIDDYYEPFDFDYQHLHNAPLGNHQPVARPRSVISGKRMEKIEWGPNWE

SEQ ID NO: 5284 - protein, 545 aa, Zea mays subsp. mays
MSMGYQVVAAQLKVASSADHASVVIITLFVALLCACIVLGHLLEENRWLNESITALIIGLCTGGVILMTTKGKSSHVLVFSEDLFFIYLLPPIIFIAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 5285 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 5286 - protein, 231 aa, Glycine max
MYTKGGATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 5287 - protein, 333 aa, Oryza sativa
MRNPPGRHLLRVATRAVRSSSALGSGGGGGGASTSATSPVAASSSSGGRPRTRSGGRLLRATSPPPPSAIAAAACWESRTMRREGEEEWEEVVAGAEEAVHGAPVPVAEEEEEYRVVFWSPPTGDEVRAAFTSIEELPFAFRVFGDPFRAHSYETEEQSALSTSVHSSSGNSSGSDDWIEPAAYALNSTALLTREHRNVLDAFRLLQKDPNVQKMVMSLSCDRAVWDAVMNNEAVHEFRRSFQDDKEAAGRKGNPGGPAGVLKWILGNTQAKIMEFMNNIMKIVNMLFHSDDDEAKPDLYTDAVKVSFMLSVFIFIVVAIARINFEPWDFKVW

SEQ ID NO: 5288 - protein, 185 aa, Glycine max
  unsure (1)..(185): unsure at all Xaa locations
PRVRLCGGKASEGVFVGAFLSMCSTAEVLKFLMEKNTTNALDGQVTIGTLILQDCAVXGLLFALVTDLGGASRGFQGERSMTKLLVTIIAFLSGLSILPRTCLTWVLNLMISLSSXTIELYQSASGALCLLXSWCSDKTGLSLXLRSFAAGVMIANTDLAHHTLEQIEPIGRLFADLFLGRVGML

SEQ ID NO: 5289 - protein, 432 aa, Cryptococcus neoformans var. neoformans
MGGCMSTPEAPKKTAETKQVPSSSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGGADINKAAKYILWRFTQTNRARLSVYPHLTQATDTSNIRLVFAAVKETILQNALRDSGIL

SEQ ID NO: 5290 - protein, 170 aa, Helicobacter pylori
GSGMHTHVSMWKNNENLFSGEAYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGH

SEQ ID NO: 5291 - protein, 311 aa, Mycobacterium tuberculosis H37Rv
MTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 5292 - protein, 256 aa, Pantoea endophytica
  unsure (1)..(256): unsure at all Xaa locations
GAAGGIGQALALLLKTQLPSGSELSXYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRXLQGEKGVVECAYVEGDGQYAR

SEQ ID NO: 5293 - protein, 531 aa, Streptomyces coelicolor A3(2)
MRPMAQVAMVMNLDKCIGCHTCSVTCKQAWTNRRGMEYVWFNNVETRPGQGYPRRYEDQDKWRGGWELNRRGALKLKAGGRFKKLAGIFSNPRLPEIKDYYEPWTYDYKNLTDAPLGTDYPVARPVSQLDGKPMKIGWSSNWDDSLGGAPAYGDLDPMVERTRQQASEKVRFAYEETFMFYLPRICEHCLNPSCVASCPSGAMYKRSEDGIVLVDQDRCRGWRMCVTGCPYKKVYFNHRTGKAEKCTFCYPRIEVGQPTVCSETCVGRLRYLGVVLYDADKVTAAAETPNERDLYEAQLDVFLDPEDPGVRRAAEEAGIPFDWIEAARRSPVHALVSKYRVALPLHPEYRTMPMVWYIPPLSPVVDALTETGHDGEDADNLFGAIDTLRIPLEYLAELFTAGDTGPVRASLEKLAAMRAHMRSVNLGEDPDPAVCAGVGMRPEEIQEMYRLLAIAKYEERYVIPTAAVGDAHRLEASALPDTCSLDTEGGPGMGGDGPFGQDSGRKRLPLVPVENFHILRRRQTADDEREV

SEQ ID NO: 5294 - protein, 496 aa, Cladosporium herbarum
MTSVQLETPHSGKYEQPTGLFINNEFVKGQEGKTFDVINPSDESVITQVHEATEKDVDIAVAAARQAFEGSWRLETPENRGKLLNNLANLFEKNTDLLAAVESLDNGKATSMARVTSACASGCLRYYGGWADKITGKVIDTTPDTFNYVKKEPIGVCRSDHSLELPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGSRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 5295 - protein, 642 aa, Nostoc punctiforme
MVKTPPSQFSPDQYKVDSAQEKVNAIIETPPSETEIDLEFLYTRDIEFRQETIYFLVVDRFYDGDPDNSEGENSELYDPNRQEWGKYWGGDLQGVIDKLDYLKNMGVTALWLTPLFEQVEELFISNAAMHGYWTKDFKRINPRYIADGENPSLNATQEEKNTTFDRLVTELHKRNMKLVLDIVCNHSSPDTSGSKGELYDDGVKIADFNDDVNHWYHHYGEVQNWEDDWQVQNCELAGLATFNENNTEYRQYIKSAIKQWLDRGVDALRVDTVKHMPIWFWQEFTGEMTNHKPDVFIFGEWIYSNPSDDRSVEFANHSGMTLLDFGLCVAIRAALGQGSEMGFQTIQYIFDQDYRYSGATELVTFIDNHDMCRFQSLNPDPAMLKVAIALIMTSRGIPCIYYGTEQYLHNDTDGGNDPYNRPMMENWDTDSEVYRCIRLLSGLRRLNPAVSMGSHWQKYLTADIYCYVRRYRDSLCFVALNRGGEVILPEVETELPDGEHTCVVTRNKYEVKDGKIYNLVLEERGVLVFSHVGERIKAQTIVRVQLNGVDTQPGEIIVVTGDCPELGNWDISKAYPLEYINSNTWSAEIPFDESTGKLIAYKYAMWREGRSPLRENLVNRRWVIAKEGTVKWRDTWASGRES

SEQ ID NO: 5296 - protein, 231 aa, Magnolia praecocissima
ENKINRQVTFAKRRNGLLKKAYELSVLCDAEVALIIFSNRGKLYEFCSSSSMLKTLERYQKCNYGAPELPVSTRETQSYHQEYLKLKARVEALQRSQRNLLGEDLGPLSGKELETLERQLDISLRQIRSTRTQCMLDQLGDLQRREHMLSEANKTLTRRLEEGAQANQNQVWEPNAHAVDSYNRQQPQQQGDGFFHPLECEPTLHIGYQPDQITIAAPGPSVNNYMPGWLV

SEQ ID NO: 5297 - protein, 355 aa, Heliobacillus mobilis
MLELKIELAPQRKEKPPADKLGFGKIFTDHMFVMDYSVEQGWHNAKIKPYEPLELDPSVMVFHYGQAIFEGMKAFRTQDNRVVLFRPEKYISRMTNSARKLCIPEFDEAFVVKAIKTLIDTERDWVYGEEGTALYIRPFIIATDPYLGVRPSHTYKFMVILSPVGAYYAEGFNPVKIFITDEFTRAAKNGLGDVKTPANYAASLYAGEKAKQMGFTQVLWLDPVEKKYIEEVGTMNVFFRIGDEVVTPVLHGSILPGVTRDSVIQVLRNWGIPVVERTISVDELFEAHAAGNLKESFGTGTAAVISPVGLLRHGDREAVINEGKTGELASRLFDSITGMQYGKSEDLFGWIADVR

SEQ ID NO: 5298 - protein, 535 aa, Oryza sativa (japonica cultivar-group)
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 5299 - protein, 701 aa, Zea mays
  unsure (1)..(701): unsure at all Xaa locations
MAPSWWGRDARANGVGGDGTPVVVRMENPNWCISEVAAAASEVDAPTSAAGGGGKAGLLGKSVRQGSWVRPVRSHSSVTGMQGGVMGYLXAASARRRMGAGRTXTQGTVYDSTDTREDLVPHSDGCIRLFLALSLLLLAVEVAAXLGGWRLEVDVGAGILAVDGLFAAAYAAWMRARLDYLAPPLQFLTNACVLLFLVQSVDRLVLCLGCFWIKLKGVRPVPPLPADKEDVEAGPDGGPMVLVQMPMCNEREVYQQSIGAVCSLDWPRSNFLVQVLDDSDDATTSALIKEEVEKWQREGVRIVYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPSPKSFPFIVPYLLFENTMSVTKFNAMVSGLFQLGSAYEWVVTKKSGRSSEGDLVALVEKHSKQQRVGSAPNLDALTKESKGTEEEKNKKKRKKKHNRIYRKELALSFLLLTAAARSLLSVQGIHFYFLLFQGXSFLVVGLDLIGEQVE

SEQ ID NO: 5300 - protein, 607 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTFSRDPVPFSLAPRLSNKMGLEAAVEATLEFLNKAVKPVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAETGDSWFNCQKLKLPKGCGYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKDDTSKELLEWGSRVSAANSRPPNPQ

SEQ ID NO: 5301 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 5302 - protein, 554 aa, Agrobacterium tumefaciens str. C58
MKAGMKRTGGQLIVEALKANGVSRVSCVPGESYLAVLDALYESGIETVVCRQEGGAAMMADTWGRLTGEPGICMVTRGPGATNASAGLHIARQDSIPMILFIGQVQREAREREAFQEVEYRRAFTEFAKWVGEIDDARRIPEFVTRAFAVATSGRPGPVVLTLPEDMLVEEVEAPEAKPYMPVEAHPGPSQMTAFAKMLGEAKRPIFIIGGTRWSEESVATFRAFAENHKLPVGCSFRRQMLFDHLSPSYAGDVGIGINPALAKEIKESDLVVLLGGRLSEMPSSGYTLIDIPYPSQKLIHIYPEAEELGRVYRPDLAICAAPDDFVAVLSSLTLSGSAAWAERTAAMHAAYLAWSTPPQTGPGTVQMGPIMDWIEANVADDAIFTNGAGNYATWLHRFHRFRRYNTQSAPTSGSMGYGLPAAVAAKHLFPEREVICFAGDGCFMMHGQEFITAVRYGLPIITVLVNNGTYGTIRMHQEREYPGRVSGTDLVNPDFNAFAKAYGGHGETVERTQDFAAAFERARASGKPGIIEVKLDPEAITPTRTLTQIRTKS

SEQ ID NO: 5303 - protein, 407 aa, Oryza sativa
MGISGEDRYPAAGGGGDSGGGKLWNLCRMPFWQPGGAPATALAPPPPSSSSSSAGIHHHSAGRYGHEGGGGGAVAGDGAPAGSISSVAKSLLPARRRLRLDPPNKLYFPYQPGQQVRSAIRIKNTSKSHVAFKFQTTAPKSCFMRPPGAILAPGETIIATVFKFVEHPENNENVLQKCKVKFKILSLKVKGPMDYAPEMFDEQRDQAVVEKILRVVFLNVENPGPLAEAEAALEARKKPPEENGPKIVGEGLVIDEWAYMAVTLGAAIELKEQVAKPCSSAAKRGASVLAVRPSSSAATAAAAAAEESLRMVMNMHAKPWVNGSYRNNSPLAKNDVANSGPPKKKEESYRYLSGWYKLVFRWTREGDQDRKAFTRTYVYSIEYLLIHFRCLGQKRKGVAKWRINALL

SEQ ID NO: 5304 - protein, 346 aa, Mycobacterium tuberculosis H37Rv
MVSPATTATMSAWQVRRPGPMDTGPLERVTTRVPRPAPSELLVAVHACGVCRTDLHVTEGDLPVHRERVIPGHEVVGEVIEVGSAVGAAAGGEFDRGDRVGIAWLRHTCGVCKYCRRGSENLCPQSRYTGWDADGGYAEFTTVPAAFAHHLPSGYSDSELAPLLCAGIIGYRSLLRTELPPGGRLGLYGFGGSAHITAQVALAQGAEIHVMTRGARARKLALQLGAASAQDAADRPPVPLDAAILFAPVGDLVLPALEALDRGGILAIAGIHLTDIPDLNYQQHLFQERQIRSVTSNTRADARAFFDFAAQHHIEVTTPEYPLGQADRALGDLSAGRIAGAAVLLI

SEQ ID NO: 5305 - protein, 360 aa, Thermobifida fusca
MRAVRYDGTGLYLSDIPAPVAGPGQVVLEVTAAGLCHSDLAVMSRPPEALPYKLPITLGHEAVGVVVDVGAGISGLAEGDTVAVYGPHGCGACRTCRSGAENHCPHARAAGILPPGLGADGALADYLLVPHSRHLVPLRGLDPVRAAPLTDAGLTSYHAVRSALPRLPPDGTALLIGIGGLGHLAVQILRALSSAQIIAVDMAADKRELALRCGADTALPSTDTVPDQVRDLTEGVGADVVFDFVASDATLRMAARSLRPGGEISIVGVGEGRLPVAVNLVPLGAVVRTPYWGTQSDLVDVLALAREGRITVEVEEYALEETPLAYERLARGNVRGRAVVNPARAPGNAPGQACAEEQRG

SEQ ID NO: 5306 - protein, 424 aa, Staphylococcus xylosus
FGTFTVTNDITKYTCASIFAEIGKQTEMFARFSTVAGERGAGDAERDIRGFALKFYTEEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYTAEEAEQVIAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSYEEQQTLFKNTANEMSPVTDALKHRHIRHCYKADSAYGQGVAEAMGID

SEQ ID NO: 5307 - protein, 458 aa, Eremothecium gossypii
MNISEAGRLLGHSRLRHIPGRRYNSMGKIRGNNYFAETTRDVWTIINEAAAKAAAESVANGGSGAGKGMKVLNLGQGFFSYSPPDFAIAGAQRALENAMNNQYAPTRGRPALVEALLKLYRPMYGDLAAENVQVTTGANEGIFACLAGLVNPGDEVIVFEPFFDQYIPNIELLGGVVRYVPIRPPAELSKRVTEGTEWVIDYDMLRQTINEKTKAVIINSPHNPIGKVFTREELLKLGNICVEKGIYIISDEVYEHLYFTDEFTRIATLSEEISQHTLTVGSAGKSFAATGWRIGWVISRNKELLALASKAHVRICFSSPAPLQEACAVAIEHALKTTYYADTRAAYQKKYERFQKPFDDLGLPYTRAEGSYFLLVDFSRLPLPADYHFPEELADKGRDFRVAYWLINELGLVAIPCSSFFIPDHREASENMLRFAICKDDTYLDEAIERLMVLKNYL

SEQ ID NO: 5308 - protein, 1003 aa, Vicia faba
MASMTMRFHPNSTAVTESVPRRGSVYGFIGYRSSSLFVRTNVIKYRSVKRNLEFRRRSAFSVKCGSGNEAKQKVKDQEVQQEAKTSPSSFAPDTTSIVSSIKYHAEFTPLFSPEKFELPQAFIATAQSVRDALIINWNATYDYYEKLNVKQAYYLSMEFLQGRALLNAIGNLELTGPYAEALSQLSYKLEDVAHQEPDAALGNGGLGRLASCFLDSLATLNYPAWGYGLRYKYGLFKQRITKDGQEEVAEDWLEMGNPWEIVRNDVSYPVRFYGKVVSGSDGKKHWVGGEDIKAVAHDVPIPGYKTRSTINLRLWSTKAASEEFDLNAFNSGRHTEASEALANAEKICYILYPGDESIEGKTLRLKQQYTLCSASLQDIIARFERRSGASVNWEDFPEKVAVQMNDTHPTLCIPELMRILIDIKGLSWKDAWNITQRTVAYTNHTVLPEALEKWSMDLMEKLLPRHVEIIEMIDEELIRTIIAEYGTADSDLLDKKLKEMRILENVELPAEFADILVKTKEATDISSEEVQISKEGGEEEETSKEGGEEEEEKEVGGGREEGDDGKEDEVEKAIAEKDGTVKSSIGDKKKKLPEPVPVPPKLVRMANLCVVGGHAVNGVAEIHSEIVKDDVFNAFYKLWPEKFQNKTNGVTPRRWIRFCNPDLSKIITQWIGTEDWILNTEKLAELRKFADNEDLQTQWREAKRNNKVKVAAFLRERTGYSVSPDSMFDIQVKRIHEYKRQLLNIFGIVYRYKKMKEMNAAERKENFVPRVCIFGGKAFATYVQAKRIVKFITDVGATVNHDPEIGDLLKVIFVPDYNVSVAEMLIPASELSQHISTAGMEASGTSNMKFAMNGCLQIGTLDGANVEIREEVGADNFFLFGAKAREIVGLRKERARGKFVPDPRFEEVKKFVRSGVFGSYNYDELIGSLEGNEGFGRADYFLVGQDFPSYLECQEEVDKAYRDQKKWTRMSILNTAGSSKFSSDRTIHEYAREIWNIEPVKLE

SEQ ID NO: 5309 - protein, 238 aa, Avena sativa
IENKISRQVTFAKRRNGLLKKAYELSLLCDAEDALIIFSGRGRLFEFSSSSCMYKTLERYRTCNYNSQEAAPLVENEINYREYLKLKTRVEFLQSSQRNILGEDLGPLSMKELDQIESQIDVSLKHIRSRKNQVLLDQLFDLKSKEQELQDQNKDLRKKLQEMSCGENAVHMSWQDGGGQSSSSGQAVDPYPGPLQHPEHDSSMQIGYHQTYMEQLBNEDHTASHHPNAQPGSSAGWI

SEQ ID NO: 5310 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 5311 - protein, 454 aa, Lactobacillus plantarum WCFS1
MQRKLSTGQMQMIALGGTIGVGLFMGSSSTIKWTGPSVLIAYIVSGAFLYLIMRALGEMLYVDPNTGSFAKFASEYIHPVFGYLTAWSNIFQFVVVGMSEMIALGGYCRYWWPNLPDWIPGLIAIVFLCAANLISVKMFGTLETWFSLIKVVTIILMIIAGLGLIIFGIGNGGHPIGISNLWTHGGFFTGGVKGFVFALAIVLASYQGIELIGVTAGEAENPQSTIVKAIRSTVARILIFYVGAIFVIVSIYPWDKLSQIGSPFVQTFAKIGITAAASIINFVVITASLSGTNSGIYSASRMTYTLAESHQLPRKMTLLNRHGVPFYSVIAIATGILIGVVLNVVLPMFFKDASEIFVMVYSSSVLPGMVPWFVILVSQIAFRKQNAAKMANHPFKMPLSPYSNYLTLAFLALTLVFMFINPETRYSILVGVVFLVIMTLIYFRKYAGNKEETL

SEQ ID NO: 5312 - protein, 468 aa, Chorda filum
TPYAKMGYWDADYNVKDTDILALFRITPQPGVDPVETAAAVAGESSTATWTVVWTDLLTACDIYRAKAYRVDPVPGTSDQYFAYIAYECDLFEEGSLANLTASIIGNVFGFKAVKALRLEDMRIPLAYLKTFQGPATGVIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAASTCGPLKAALDLWKDITFDYTSTDTPDFVEQATESK

SEQ ID NO: 5313 - protein, 153 aa, Oryza sativa (japonica cultivar-group)
MLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 5314 - protein, 442 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQHKYKFAAKKLCPTSLPQELFL

SEQ ID NO: 5315 - protein, 445 aa, Phyllophora antarctica
  unsure (1)..(445): unsure at all Xaa locations
FRVSPQPGVDPVEASAAVAGESSTATWTVVWTDFLTACDLYRAKAYKVDAVPNTSDQYFAYIAYDIDLFEEGSIANLTASIXGXXXXFKAITALRLEDMRLPVAYLKTFQGPATGVICERERMDKFGRPFLGATVKPKLGLSGKNYGRVVYEGLKGGLDFLKDXXXXXXQPFMRWKERYLYSMEGVNRSIAAAGEIKGHYLNVTASTMEDIYERAEFAKQLGSIIVMVDLVIGYTAIQSMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGVDVVLQFGGGTIGHPDGIQAGATANRVALESIVIARNEGRDFVAEGPQILQDAAKTCGPLQTALDLWKDITFNYTSTDTPDFVETPTANV

SEQ ID NO: 5316 - protein, 562 aa, Saccharomyces cerevisiae
MNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEVNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAEGLGVPWEPVDLEGYAKTWSIASAN

SEQ ID NO: 5317 - protein, 423 aa, Oryza sativa (japonica cultivar-group)
MAGIRLTPEEPELPQGTPPRPQLPPAFAGAGAVLAGSGSGGGGGLEMASDDERSVAADSWSVRSEYGSTLDDDQRYADAAEVLAAAAASANFPSDTLQGYVVSCSCGVAVRTFYFVHFLVATSLMIAFRIVIKYVERGSARDVFASFVVIGQVGIGSQMRIQIDCVLTKMIKILARLKAQCWGSKVIGMLLIQKILQIFRNMGMLEKYDVMDTMAVWTKKLCIDIINGGTPSGNESINCEVDEKQLSNYPVLDVGTGNGLLLQALAKQGFSNLTGTDYSEGAIELAKNLAARDGFTSINFLVDDILETKLDRKFKIVTDKGTLDAIGLHPDGRIKRVMYWESVSNLVEPGGIVVVTSCNHTKDELVQEVEDFSKTKSGKEHLDEGEGNVPQIFRYIDHVRTYPTIMFGGVEGSQVCTVAFQRV

SEQ ID NO: 5318 - protein, 277 aa, Klebsiella oxytoca
EIVAINDLLDADYMAYMLKYDSTHGRFNGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 5319 - protein, 667 aa, Magnetospirillum magnetotacticum
MREAAVSKVETLQRPKTRDVSLDDVERGVQSAARALTDMTQADGHICFELEADATIPSEYILFHHFRGTEPRAGLEAKIGNYLRRTQSKVHGGWALVHDGPFDMSASVKAYFALKMIGDDIEAPHMRAVRKAILQRGGAANANVFTRILLALYGEVPWTAVPVMPVEVMHLPKWFPFHLDKVSYWARCTMVPLFVIQAKKPRAKNPRGVGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLEVGGTQAEANARAGLDWLKPLQILDIKGDWAETKPNVRPGGWAFQYANPHYPDLDDTAVVVMAMDRAQRQHGLVSGMPDYSTSIARAREWVEGLQSADGGWAAFDADNNHHYLNHIPFSDHGALLDPPTADVTARVVSMLAQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGADGLWNEERYTATGFPRVFYLRYHGYPKFFPLWAMARFRNLKRGNSRQVQFGM

SEQ ID NO: 5320 - protein, 393 aa, Zea mays
  unsure (1)..(393): unsure at all Xaa locations
GXARRARLPPXEMGWPLVGGMWDFLRAYKSGMPDTFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 5321 - protein, 507 aa, Zea mays
MDSPPLQPTVFSLILALILVLYLALRRRGGGKNRSYPPVAGTVLHQLFNFGRLMEYQTALSRRYRTFRMLTPTCSYIYTVEPANVEYILKANFGNYGKGSTLHELSEDLLGDGIFNVDGAKWRHQRKVASHEFSTRVLRDYSTGVFRDTAAELAGIVAAAAAAAGEKLDMQELLMRSTLDSIFKVGFGVSLGVLSGSSEEGAAFAKAFDDASEQVLRRFLDPFWKAKRFLNFSSEAAMKRSLRTINGFVYAVVDRKIEQMERDQQEFVSPEDITSPFLVERESDPGCSDNKYLRDIILNFVIAGRDTTAGTLSWFLYVLCRNQSIQDRIAQEVRAATSGDGGLGAPELVACLTEDAISKMHYLHAALTETLRLYPSVPIDVKCCFSDDTLPDGYAVKKGDMVNYQPYQMGRMRFLWGAGAEEFRPERWLDDAGVFVPESPFKFTAFQAGPRVCLGKEFAYRQMKIFAAALLYLFRFEMWDANATVGYRAMLTLKIDRPLYLRTSLRR

SEQ ID NO: 5322 - protein, 331 aa, Glycine max
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 5323 - protein, 315 aa, Zea mays
MRLRGVLLVLVLLLAATAVVPVLLLSENDDDGVAPAPPFNSSRVKAVSWHPRIFVYKGFLSDAECDHLVTLAKKKIQRSMVADNESGKSVMSEVRTSSGMFLDKRQDPVVSRIEERVAAWTFLPQENAENMQVLRYEPGQKYEPHFDYFHDRVNQARGGHRYATVLMYLSTVREGGETVFPNAKGWESQPKDATFSECAHKGLAVKPVKGDAVLFFSLHADGTPDPLSLHGSCPVIRGEKWSAPKWIHVRSYEEDEPPAVLVLPEETDGGCTDRSERCAEWAAAGECARNPAYMLGAGDEGAPGQCRRSCGVCDS

SEQ ID NO: 5324 - protein, 278 aa, Cladonia arbuscula
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 5325 - protein, 77 aa, Oryza sativa
  unsure (1)..(77): unsure at all Xaa locations
KPPLAESFAVVKSSSGPEXRDFRESLEEMIAENGIRTAADLEDLLACYLSLNAAEYHDLIVXDVFEHIWANLADIKM

SEQ ID NO: 5326 - protein, 241 aa, Ralstonia eutropha
MHATEPNTGHGSQRAIRLAPSILSADFARLGEEVCAIEAGGADLVHFDVMDNHYVSNLTIGPLVCEAIRPLVSIPIDVHLMVEPVDALIPMFAKAGANLISFHPEASRHVDRTIGLIRDHGCKAGLVLNPATPLSWLDHTLDKLDLVLLMSVNPGFGGQAFIPGVLDKVRQARARIDRQVAAGGRPVWLEIDGGVKADNITEIARAGADTFVAGSAVFGAPDADGGYRGILHRLREAATIT

SEQ ID NO: 5327 - protein, 272 aa, Zea mays
  unsure (1)..(272): unsure at all Xaa locations
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGEFDGHSKRVLSCDFKPTRPFRIVTCGEDFLANYYEGXPFKFKHSIRDHTNFVNCIRYSPDGTKFITVSSDKKGLIYDGKTGDKIGELSSEGSHTGSIYAVSWSPDSXQVLTVSADKXEVWDIXEDGSGTLNRT

SEQ ID NO: 5328 - protein, 497 aa, Ammi majus
MDVIIIVLSVMLAYVLVKHLLLSRDRGKNLPPGPFQLPIIGNLTNLGKLPHRSLAKLSQNYGPIMHLQLGRVTTIVISSSAIAQQVFQKKGRAFSRRFIPDSLCACDHSLYSFVWLPIGPQWRNLRKISNSNLFSANKLDANQHLRGRKVNELIAYVQKCSQTGDAVDIGRAAFRTSFNLLSNTVFSKDMVDPYQDSAQEFKDLAWNIMVEAGSPNLVDYFPVLKKMDPQGVKRRMTGYFQKVIKMLDGLINERLALKGSGTTVDKTDMLDELINISQVNPNEMDKILMEHLFVDIFVAGTDTTSNTVEWGMAEILRSTETMMKVKAELRHLVGKGVILEEGDIYRLPFLQCIVRETLRLHPPFPLLLPRQTEEETELNGYTIPKNSQVLVNAWAIGRDPVSWKNPSSFRPERFLDSEVDVKGQDFELIPFGAGIRICPGLPLVMRMVPVMLGSLINCFDWELEGGIPLNELDMEEKCGLSVAKLHPLRVLATSQVV

SEQ ID NO: 5329 - protein, 215 aa, Brassica oleracea
VSKFTVGDVVGVGVIVGCCGRCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLASLKLDGKLILMGVINTPLQFITPLVILGRKVIS

SEQ ID NO: 5330 - protein, 424 aa, Oryza sativa
MWGLGLVKPMEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPPEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEARSSPMTPAGRAHRVHPQGCRQNNCRRSRSSSPSPPAPTSAPRRRPSATRRTLSLPWRAASPLDSSCLEFSRR

SEQ ID NO: 5331 - protein, 711 aa, Geobacillus stearothermophilus
MRRWLSLVLSMSFVFSAIFIVSDTQKVTVEAAGNLNKVNFTSDVVYQIVVDRFVDGNTSNNPSGALFSSGCTNLRKYCGGDWQGIINKINDGYLTDMGVTAIWISQPVENVFSVMNDASGSASYHGYWARDFKKPNPFFGTLSDFQRLVDAAHAKGIKVIIDFAPNHTSPASETNPSYMENGRLYDNGTLLGGYTNDANMYFHHNGGTTFSSLEDGIYRNLFDLADLNHQNPVIDRYLKDAVKMWIDMGIDGIRMDAVKHMPFGWQKSLMDEIDNYRPVFTFGEWFLSENEVDANNHYFANESGMSLLDFRFGQKLRQVLRNNSDNWYGFNQMIQDTASAYDEVLDQVTFIDNHDMDRFMIDGGDPRKVDMALAVLLTSRGVPNIYYGTEQYMTGNGDPNNRKMMSSFNKNTRAYQVIQKLSSLRRNNPALAYGDTEQRWINGDVYVYERQFGKDVVLVAVNRSSSSNYSITGLFTALPAGTYTDQLGGLLDGNTIQVGSNGSVNAFDLGPGEVGVWAYSATESTPIIGHVGPMMGQVGHQVTIDGEGFGTNTGTVKFGTTAANVVSWSNNQIVVAVPNVSPGKYNITVQSSSGQTSAAYDNFEVLTNDQVSVRFVVNNATTNLGQNIYIVGNVYELGNWDTSKAIGPMFNQVVYSYPTWYIDVSVPEGKTIEFKFIKKDSQGNVTWESGSNHVYTTPTNTTGKIIVDWQN

SEQ ID NO: 5332 - protein, 195 aa, Bacillus cereus ATCC 14579
MIVLIDNYDSFTYNLYQLLGEHEEEIVVVRNDEIMIEQLEEMNPTGIVLSPGPGKPEDAGICIEVIRHFYKNVPILGICLGHQAIISAFGGDIVRAERIKHGKTSRVKHNGTSIFSYVTQPLTAMRSHSLVAAQTSLPECFLILATAMDDGEIMAVRHNYYPLFGLQFHPESIAPEEGGKLIRAFLTEVKEEERV

SEQ ID NO: 5333 - protein, 77 aa, Triticum aestivum
MAQLQETYACSPATERGRGMRAAGDAKTDTIAYCSGRSVIFRRLDAPLDAWAYTEHAYPTTVARFSPNGEWVASADA

SEQ ID NO: 5334 - protein, 590 aa, Triticum aestivum
MATTSRLLLLLAAVCLLAGAADALRLPPDASFPGAQAERLIRALNLLPGASSGRGGKVGAVAEDVPPGQLPTKPLPPLPTIAPSMATTSRLLLLLLLAAVCLLAGAAVDALRLPPDASFPGAQAERLIRALNLLPGASSGRGGKVGAGAVDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYERINKFIPPCEFAIKLCGTDGKASCMAAYMVCNSIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKESVPEEEPATTFYAAI

SEQ ID NO: 5335 - protein, 183 aa, Zea mays
  unsure (1)..(183): unsure at all Xaa locations
MSVQEYLXEKHLLSRKIEEAVNAAVRAKAPDPALFIVGHMRREAPTVITRVRARQILDGRXHPALRVELHTNKAVHRASTASVGALEGAAADAAGASERRKFLARGVAYAVRVINDKVSEALVGMDPQQQTQIDQAIMXLDRARHKVPLYKHIADLVGKSATTLRVPAITVINGGRAHEDTRI

SEQ ID NO: 5336 - protein, 343 aa, Nostoc sp. PCC 7120
MAKLKVGINGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMVQKEQLAAV

SEQ ID NO: 5337 - protein, 131 aa, Zea mays
AKLVYPERNIVAVTGDGGFMMNCQELETAMRVGTPFVTLIFNDNGYGLIEWKQINQFGESSFIKFGNPDFVKFAESMGLKGYRVEAAADLIPILKEALAQPVPTVIDCPVDYRENIRFSQKAGELACEIWE

SEQ ID NO: 5338 - protein, 251 aa, Bacillus anthracis str. A2012
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 5339 - protein, 193 aa, Triticum aestivum
  unsure (1)..(193): unsure at all Xaa locations
IRHEPPSKLYTYIAQPWAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWTMXKLPMFGCTDATQVINEVEEVKKEXYPDAYVRIIGFDNMRQVQCVSFIAFKPPGCEESGKA

SEQ ID NO: 5340 - protein, 308 aa, Neocallimastix patriciarum
MAQKKQQQKLGFYEDFLLAGVSATISKTAAAPLERVKLLVQNQGEMLKSGRLATPYKGIGDCFVRVAKEEGIASFWRGNGANIIRYFPTQALNIAFKERIKNAFAVDKEKEGYAKWLVANIASGGAGGALSQVFVYSLDYARTRLANDAKSANGGERQYKGLIDVYKKTYKADGIAGLYRGFTLSCVGIMVYRGLYFGLYDSMKPLLKNLGMEGSFAASFILGWGVTTVAGIASYPIDTIRRRMMMTSGEAVKYKSSIDCAKQVMQKEGVQAFFKGCGANILRGVAGAGVLSGFDKIKEVYINWRIKN

SEQ ID NO: 5341 - protein, 299 aa, Zea mays
MNFGRHLLLAAVFALLLAVCASAASRGAGSFDPSRVVQLSWRPRAFLHKGFLSDAECDHLIALAKDKLEKSMVADNESGKSVQSEVRTSSGMFLERKQDEVVTRIEERISAWTFLPPENGESIQILHYQNGEKYEPHYDYFHDKKNQALGGHRIATVLMYLSNVEKGGETIFPNAEGKLLQPKDNTWSDCARNGYAVKPVKGDALLFFSLHPDATTDSDSLHGSCPVIEGQKWSATKWIHVRSFDLPVKQPGSSDGCEDDNILCPQWAAVGECAKNPNYMVGTKEAPGFCRKSCKVCAE

SEQ ID NO: 5342 - protein, 412 aa, Zea mays
MAAAGEGEAERVSALLREITGEGGFAFVASAEKAGAGDLRAAEAAREMAWEQLHSGPWSEVGTAWRDAYALACLNVARLRTHAASGGDSDRSAALRALDMGLIMGGNLLRADLEAALARISAEACGGSEGGEGVVDKENQRWREALDRNRDIADALKILPANSLSCKKVERRSCISLEEFICNYFLRDTPVIISGTIDHWPARTKWKDIEYLKKIAGDRTVPVEVGKNYVCSEWKQELITFSQFLDRMSSTVCPSNLTYLAQHPLFEQIKELSEDIIVPEYCYAGGGALQSLNAWFGPEGTVTPLHHDPHHNILAQVLGRKYIRLYPAFIAEDLYPHTETMLSNTSQVDLDNIDLKEFPRVENLEFIDCILEEGDLLYIPPKWWHYVRSLSTSFSVTPLLNGCTHVITNVHC

SEQ ID NO: 5343 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWCEEEHQATTAEFEAAVIAAQKEAEQYGTLANGHIPSAASMFEDVYKEMPDHLRRQRQELGV

SEQ ID NO: 5344 - protein, 352 aa, Oryza sativa (japonica cultivar-group)
MARTMTMRVSSLLVAVVLLAALSFQACSGHGGINDGDGQVDAPATPASSSGVRSKGLIAVKVWCLVILLVFTFAGGVSPYFYRWNESFLLLGTQFAAGVFLGTALMHFLADSTSTFKGLTTNQYPFSFMLTCVGFLLTMLSDLVIAAVARRSAAAGVSDNQVSEQQQRQQAEGAVMSRKEEEAAAVAHPAMLVRTSSFEDAVLLIVALCFHSVFEGIAIGVSASKSEAWRNLWTIGLHKIFAAVAMGIALLRMIPKRPFLMTVVYSLAFAVSSPVGVGIGIAIDATSQGRAADWTYAISMGLATGVFIYVAINHLIAKGYRPHHPTAADKPLFKFLAVLLGVAVMAVVMIWD

SEQ ID NO: 5345 - protein, 496 aa, Cucurbita maxima
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 5346 - protein, 81 aa, Oryza longistaminata
YVKFHWKPTCGVSCLMDDEATLVGGKNHSHATQDLYDSIAAGNFPEWKLFVQVIDPEEEERFDFDPLDDTKTWPEEEVPLR

SEQ ID NO: 5347 - protein, 447 aa, Zea mays
MGQGTPGGMGKQGGAGDRKPGDAGEKKDKKFEPPAAPSRVGRKQRKQKGAEAAARLPNVAPLSKCRLRLLKLDRVKDYLLMEEEFVAAQERLRPQEDKAEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 5348 - protein, 134 aa, Vibrio vulnificus
MRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHA

SEQ ID NO: 5349 - protein, 203 aa, Nicotiana benthamiana
MGNTEKLMNQIMELKFTSKSLQRQARKCEKDEKSEKLKVKKAIEKGNMDGARIYAENAIRKRSEQMNYLRLSSRLDAVVARLDTQAKMTTISKSMGNIVKSLESSLATGNLQKMSETMDKFEQQFVNMEVQAEFMESSMAGSTSLSTPEDQVNSLMHQVADDYGLEVSVGLPQAAGHAIPTKDSEKVDEDDLTRRLAELKARG

SEQ ID NO: 5350 - protein, 331 aa, Thermobifida fusca
MLLESALLAVVLAALLFAFTNGLHDSAHTIVTAIVSRALTPGVAIALATLMTLLGAFLGEGVARTIGQDFISPIHGADGLAVLFAALSSAAAWNLFSWYRGMPSSASHALIGGMVGAALASQGEVRWDGVLISFLVPMLVAPLLGWLLGYLIMLGILWLFRDTSPGVVNRGFRLAQSVSAAMLSLGNGLQDAQKTMGIVVLALITVGSQNTYEVPTWVTLCSAVAISLGTATGGWRIMRTLGWRMSRIDPPQGFAVEAAVSAIMGFTSLVWHAPISSTHTTTSAIAGAGTARRVTGVRWGIFATIVLFWLVTVPVTAVIAAGVYGLLHTVV

SEQ ID NO: 5351 - protein, 236 aa, Glycine max
EFLKGLSLLTSLRHENIVKMRGFCCSRSRGEWFFVCDFATRGNLSQYLDKEDGSDHVIEWSKRVSIIKGIAKGIGYLHNNEASKPTIVHQNISVEKVILDHEFNPLITDAGLPKLLADDVVFSALKASAAMGYLAPEYLTTGRFTEKSDIYAFGVIVLQVLSGKVLMGGTIRVAVEAFRFEDFVDTNLKGDYSKSEAAILSKLAIQCTLEVPEQRPTMVEVIQELTMLPNPSSHSS

SEQ ID NO: 5352 - protein, 331 aa, Thermus aquaticus
MKVGINGFGRIGRQVFRILHSRGVEVALINDLTDNKTLAHLLKYDSIYHRFPGEVAYDDQYLYVDGKAIRATAVKDPKEIPWAEAGVGVVIESTGVFTDADKAKAHLEGGAKKVIITAPAKGEDITIVMGVNHEAYDPSRHHIISNASCTTNSLAPVMKVLEEAFGVEKALMTTVHSYTNDQRLLDLPHKDLRRARAAAINIIPTTTGAAKATALVLPSLKGRFDGMALRVPTATGSISDITALLKREVTAEEVNAALKAAAEGPLKGILAYTEDEIVLQDIVMDPHSSIVDAKLTKALGNMVKVFAWYDNEWGYANRVADLVELVLRKGV

SEQ ID NO: 5353 - protein, 135 aa, Azospirillum amazonense
MVRKFNVLAMVMQSFTITCLVTVIWALVGYSLSFTAASDAADAKEFIGGFSRVLLAGMDPTGTHALAPTIPEPVFMMYQMTFAIITPALITGAFADRMKFSAMLIFITLWSLVVYAPVAHTVWHPNGFMGKLGVL

SEQ ID NO: 5354 - protein, 423 aa, Triticum aestivum
  unsure (1)..(423): unsure at all Xaa locations
MAAASFTAAKFLAPAAARSGGDRARPFPAPSAFSMRSLRHRPARRLSSVLAVSSDVLKAAPAAAAYPAVTREEALELYEDMILGRNFEDMCAQMYYRGKMFGFVHLYNXQEAVSTCFIKQLNQPDCVVSTYRDHVHALSKGVXARAVMAELFGKATGCCRGQGGSMHMFSEPHNLLGGFAFIGEGIPVATGAAFAAKYRHEVLKQSSPDGLDVTLAFFGDGTCNNGQFFECLNMAPAXKLPIYFLLWRTTLWAIGNFXLGATSDPEXIGRRGPAFGMPGVHVDGMDVLKVREVAKEAIDRARRGEGPTLVECETYRFRGHSLADPDELREAXEKSHYAARDPITSLKKYIIEQNLASEAELKNIEKKIDDVVEEAVEFADASPLPPRSQLLENVFADPKGFGIGPDGKYRCEDPKFTQGTAQV

SEQ ID NO: 5355 - protein, 527 aa, Novosphingobium aromaticivorans
MGPAPPSQGRARPQRHPLPRQAGDMAPGDAQPSVITRPAEQRLQGLTTMTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 5356 - protein, 488 aa, Eschscholzia californica
  unsure (1)..(488): unsure at all Xaa locations
MEVVTVALIAVIISSILYLLFGSSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGXPNSGSSEFKEYLWRMLELGNSTNPADYFPMLGKFDLFGQRKEVAECLKGIYAIWGAMLQERKLAKKVDGYQSKNDFVDVCLDSGLNDYQINALLMELFGAGTETSASTIEWAMTELTKNPKITAKLRSELQTVVGERSVKESDFPNLPYLEATVKETLRLHPPTPLLLPRRALETCTILNYTIPKDCQIMVNAWGIGRDPKTWIDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 5357 - protein, 313 aa, Lactococcus lactis subsp. cremoris
MKQTTIPNKARKVRKAVIPAAGLGTRFLPATKAIAKEMLPIVDKPTIQFIVEEALKSGIEDILIVTGKAKRPIEDHFDSNIELEQNLLEKGKTELLKLVEETTDINLHFIRQSHPKGLGHAVLQAKAFVGNEPFVVMLGDDLMNITGNETPLTKDLINDYEKTHASTIAVMKVPHEDVDKYGVIDPNGEVSKGLYNVERFVEKPKVEEAPSDLAIIGRYLLTPEIFDVLETQVPGAGNEIQLTDAIERLNKTQRVFAHEFTGKRYDVGDKLGFVETTIEYGLEHPQIGDNLKNYIIEKAKELSKDELKQNTKK

SEQ ID NO: 5358 - protein, 488 aa, Colpomenia sinuosa
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIIMIDLVIGYSAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAASCGPLKAALDLWKDITFDYTSTDTPDFVEVATGSR

SEQ ID NO: 5359 - protein, 177 aa, Glycine max; identical to SEQ ID NO: 988

SEQ ID NO: 5360 - protein, 196 aa, Mitthyridium sp. Wall 3656
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIALSDTFVNS

SEQ ID NO: 5361 - protein, 196 aa, Zea mays
  unsure (1)..(196): unsure at all Xaa locations
YKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAESEGSLRGILGYVEEDLVSTDFQGDSRSSIFDAKAGIALNGNFVKLVSWYDNEWGYSTRVVDLIXHMNSTN

SEQ ID NO: 5362 - protein, 500 aa, Escherichia coli
MLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEENFLDWGWRIPFFIALPLGIIGLYLRHALEETPAFQQHVDKLEQGDREGLQDGPKVSFKEIATKHWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMSPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 5363 - protein, 187 aa, Chlorobium tepidum TLS
MILVIDNYDSFTYNLVQYIGELGAEVAVYRNDELTVEQALALEPEKIVISPGPGTPADAGISIPLINVVKGNIPLFGVCLGHQAIGEALGGKVVRAGQIMHGKTSQIYHDGKGVFRGLPNPFTATRYHSLVVERESLPAELEITAWTEDGVIMGLQSSELGLYGVQFHPESIMTSVGHDLIRNFLEL

SEQ ID NO: 5364 - protein, 207 aa, Ranunculus bulbosus
RHEMSGVCDAEVALIVFSTKGKLFEYSTDSGMDKILERYERYSYAERKLGASDTDSQGNWSLEYTKLKAKVEILQKNQRHFRGEDIANMSLKELQNLEQQLDSALKLIRARKNQLTYESISDLQKKEKVLQEQNNQLEKQLKEKEKELAKREQWEQPNQGQTSRSFTPQSPSSLNIGGSYQGNNGGEGFQTQNRPTILMPPWMLSHL

SEQ ID NO: 5365 - protein, 957 aa, Oryza sativa
MATASAPLQLATASRPLPVGVGCGGGGGGGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 5366 - protein, 374 aa, Zea mays
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECMQNLNVVCQYYPPCPEPHRTVGVKRHTDPGFFTILLQDGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDGRALDHFRL

SEQ ID NO: 5367 - protein, 488 aa, Geobacter metallireducens
MKFKLSFVALLATVALSLPVALLAEEVKTAAPAQAALSSAQTAALAPAVTAAPAAAPATPAAPKNVDPVLNTGDTAWMLVSAAMVLFMIPGLAFFYGGMVRGKNVLSTIMHSFVAMGIVGVQWAVIGYSLSFGPDIGGGLLGNLSKALLNGLITFKDGNPVYALFQNVPTAPGAIPEYVFAMFQCMFAMITVALISGALAERVKFSAYCVFVLLWTTLVYDPLAHWVWMSDGWLFKKGALDFAGGTVVHLSSGISALAFLIFLGKRHGFPHERMAPHSLPLTMLGVGMLWFGWFGFNAGSAIVGANCSDAAGGLAGLAFATTTIAPAAGGLSWMIAEWIHAGKPSALGFGSGVVAGLVVITPAAGFVQPGAAILMGLAAGVVCYGGVLLKAKLKYDDSLDAFGVHGVGGTFGALTTGIFATVGATGLLSGNVSQFLTQVIAVVAAGAYAFIVTLVIAFVLHKTIGLRVEKEDEIMGLDQTQHSESAYN

SEQ ID NO: 5368 - protein, 480 aa, Valeriemaya cruenta
QVIKNQRYESGVIPYAKMGYWDPNYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTASTMEDMYERAEFAKDLGTVIVMIDLVIGYTAIQSMGIWARKNDMILHLHRAGNSTYSRQKIHGMNFRVICKWMRMAGVDHIHAGTVVGKLEGDPLMIRGFYNTLLESHLDINLPQGIFFQQDWASLRKVTPVASGGIHCGQMHQLLDYLGVDVVLQFGGGTIGHPDGIQAGATANRVALESVLIAKNEGRSYVEEGPQILRDAAKTCGPLQTALDLWKDITFNYTSIDTADFVETPTANV

SEQ ID NO: 5369 - protein, 296 aa, Xylella fastidiosa Ann-1
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGCKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKR

SEQ ID NO: 5370 - protein, 332 aa, Streptomyces avermitilis MA-4680
MDTFALIVTIGVALGFTYTNGFHDSANAIATSVSTRALTPRAALAMAAVMNLAGAFLGSGVAHTVSKGLIETPEGSKGMGILFAALIGAIVWNLVTWYFGLPSSSSHALFGGMVGAALAGGTEVIWSGVLDKVVIPMFLSPVVGLVAGYLVMCAIMWIFRRANPHKAKRGFRIAQTVSAAGMALGHGLQDAQKTMGIVVMALVIGDVQGADDPIPVWVKIACALMLSLGTYAGGWRIMRTLGRKIIELDPPQGFAAETTGASIMFVTAFIFKAPISTTHVITSAIMGVGATKRVNAVRWGVAKNIVLGWFITMPAAGLVAACSFWIVNLAFL

SEQ ID NO: 5371 - protein, 399 aa, Zea mays
MDGGGQPPDTEMSEAGAGGGGQPPQQPLPPVGGGVMLDNIQATLSHGGRFIQYNIFGNVFEVTAKYKPPLLPIGKGAYGIVCSAVNSETAAEGGPSKKIANAFDNKIDAKRTLREIKLLRHMDHENIVAIRDIIPPAQRAAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEGDLDFVNENARRYIRQLPRHPRQSLPEKFPHVQPLAIDLVEKMLTFDPRQRITVEGALAHPYLASLHDISDEPGCSMPFSFDFEQHALSEEQMKDLIYQEALAFNPDYQ

SEQ ID NO: 5372 - protein, 81 aa, Glycine max
  unsure (1)..(81): unsure at all Xaa locations
TAKNTAPAETTDNRAGAGRXAPXTGRKAKAGHPTRKTNNDSTTRASNGGRXQGMHFLPPVGKKKGETLSYPPDLDDAQLSK

SEQ ID NO: 5373 - protein, 390 aa, Corynebacterium efficiens YS-314
MVMNPSPLSNRSNVPPFRVMQMLDQVHRRRREGHSIIMLCAGQPATGAPEAVLAEAEIVLRSGPLGYTEVVGDREFREAVAAWHSATYGVQTSADNVIITTGSSGGFMAAFLATLDHGDRVALSVPGYPAYRNILQTLGAEILDLRCTAETRFQPTAQMLEELPEVPKAVIVTSPGNPTGTIIDVEELERIARWCDANGTVLISDEDYHGMSFGRPLATARQFSDNAIVVGTLSKYFSMTGWRVGWIIVPDELVTPIENIQASVSLCAPAIGQAAGKAAFTLEAAAELDAHVEVYREARDIFVDKLPEIGLDTFADPDGGLYLWVDVSKYTDDSEAWAHELLEQAGVAVAPGVDFDPTEGHKWVRLSLCASPADTLEGVRRIGEFLNRVV

SEQ ID NO: 5374 - protein, 298 aa, Triticum aestivum
  unsure (1)..(298): unsure at all Xaa locations
GLLAGFDPGVLPVLDFPRHEPALWCLHLVRCDNSVIRNVSIYGDFDTPNNDGIDIEDSNNTVIADCHIDTGDDAICPKSSTGPVYNLTATNCWIRTKSCAIKFGSASFFNFEKLLFDNITIVDSHRGLGMQIRDGGNVSDVTFSNIKMRTRYYHPSWWGXRAEPIYITTCPRHPDSKEGTISDVRFINISSVSENGVFLAGSKHGLLRNLKFQNVDLTYKRWTNYTGGLYDYRPGCQKMVKHKTGGMMLEHISGLEVDNVSMRWWRGSLKGWDVNPLLFRPSTIDGLSFHDLQSLDVQ

SEQ ID NO: 5375 - protein, 639 aa, Escherichia coli
MSQPIFNDKQFQEALSRQWQRYGLNSAAEMTPRQWWLAVSEALAEMLRAQPFAKPVANQRHVNYTSMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWTLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINETNTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKHANKVRLAEFVKVRTGIDINPQAIFDIQIKRLHEYKRQHLNLLRILALYKEIRQNPQADRVPRVFLFGAKAAPGYYLAKNIIFAINKVADVINNDPLVGDKLKVVFLPDYCVSAAEKLIPAADISEQISTAGKEA

SEQ ID NO: 5376 - protein, 327 aa, Trichoderma viride
  unsure (1)..(327): unsure at all Xaa locations
ENQLKRDKXMQRNEIKMLLLGAGESGKSTILKXMKLIHEGGYSRDERESFKEIIFSNTXQSMRVILEAMESLELPLQDXRMEYHVQTIFIQPAQIEGDVLPPEVGGAIEALWKDHGVXECFKRSREYXLNDSARYYXDXIVXIAGXXYMPXDQDVLRSRVKTTGITETTFIIGDLTYXMFDVGGQRSEXKKWIHCFENVTTILFLVAISEYDQLLFEDETVNRMQEALTLFXSICNSRWFIKTSIILFLNKIDRFKEKLPVSPMKNYFPDYEGGDDYXAACXYILNRFVSLNQHETKQIYTHFTCATDTXXIRFVMAAVNXXIXXDN

SEQ ID NO: 5377 - protein, 333 aa, Pseudomonas putida KT2440
MTLRIAINGFGRIGRNVLRALYTQGYRQDLQVVAINDLGDSTMNAHLLKYDSVHGTFDATVEADHESLTVNGDRIAVSAIRNPAELPWKAEAIDVVFECTGLFTDRAKAAAHLAAGAGKVIVSAPAKGADATVVYGVNHDILRASHQIISNASCTTNCLAPIAQVLHREFGIEQGLMTTIHAYTNDQVLTDVYHSDPYRARSATQSMIPSKTGAAEAVGLVLPELAGKLTGMAVRVPVINVSLVDLTVNLKREATAEQVNQLFLEASKHSKVLGYNALPLVSCDFNHNPLSSIFDANHTRANGRMLKVLAWYDNEWGFSNRMLDNCLALHRAG

SEQ ID NO: 5378 - protein, 293 aa, Burkholderia fungorum
MLKVTKAVFPVAGLGTRFLPATKASPKEMLPIVDKPLIQYAVEEAMAAGITEMIFVTGRSKRAIEDHFDKSYEVEAELEARGKDKLLQLVRSIKPSHVDCFYVRQPEALGLGHAVLCAEKLVGDSPFAVILADDLLYGSPPVMTQMIEVFDHYHSSVIGVEEIPAQDTKSYGIVDGKEWEQSIIKMSGIVEKPEPSAAPSNLGVVGRYVLKPRIFKHLRTIKPGAGGELQLTDAIESLLADEQVLAYKYRGTRFDCGSKIGYLKATVEFAVRHPEVGVEFREYLEEYLSLLPM

SEQ ID NO: 5379 - protein, 132 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5380 - protein, 128 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 5381 - protein, 378 aa, Leuconostoc mesenteroides
MVNMDEVLSIHQAHTGVLDIESCFDITTPTDLSEAYTPGVAGLAKLIAKDTSKKRDYTMSGKLIPVITDGSAVLGLGNIGPAAGLPIVEGKALIYKNFANVDALPMALNQMSVDQFVDTVKAIAPSFAGIHLEDISAPKVFEIERRLSNELDIPVYHDDQTGTAIVVLAGIMNAAKVVGKNVHDLKIVVNGIGRCTAGVATTKILIAAGICNITLVDINGVINLGDANSNSYQQELVREVTQVDGKTLDDVIANQDVFIGLSDANVLSGKQVARMNENPIIFALANPVPEISPDDAKKAGAAVIATGSSQWPNQVNNVLVFPGLFKGLLESGIKHVDMALQLNVAHALANMISEPDATHIVPAVFDDDVGELGRNSSS

SEQ ID NO: 5382 - protein, 253 aa, Coptis japonica
MGRKFFVGGNWKCNGTSEEVKKIVTLLNEAEVPSEDVVEVVVSPPYVFLPFVKNLLRADFHVAAQNCWVKKGGAFTGEVSAEMLVNLGIPWVILGHSERRALLNESNEFVGDKTAYALSQGLKVIACVGETLEQREAGSTISVVAAQTKAIAEKVSDWTNIVVAYEPVWAIGTGKVASPAQAQEVHFELRKWIKENVGADVAGSVRIIYGGSVNGANSKELAGQPDIDGFLVGGASLKPEFVDIIKSATVKSS

SEQ ID NO: 5383 - protein, 157 aa, Zea mays
MAAASGRAPSACALLLLFLLLVVGAAAAAVIVVDANRGEQEQEQDWDWEQLSAASPSPWSPAPAPAPSPVSFIDCGSACGARCALSSRWNLCRRACGSCCARCNCVPPGTAGNHDVCPCYAAITTRGGRPKCPSLTYAWAMPPRATPLLLSCVPLAA

SEQ ID NO: 5384 - protein, 258 aa, Triticum aestivum
MSATCAADLAPLLGAAAMNATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAIAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTSCSGSAGTVQPGSFVT

SEQ ID NO: 5385 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 5386 - protein, 75 aa, Zea mays
  unsure (1)..(75): unsure at all Xaa locations
KPFSDIRFYILLQATIICIDELLCMRNNHYSXNNFQAQADAVNLICSANTHSNPKNTIGVMTMAAKGDHFLNTPT

SEQ ID NO: 5387 - protein, 528 aa, Oryza sativa (japonica cultivar-group)
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 5388 - protein, 781 aa, Leptospira interrogans serovar lai str. 56601
MKNRIANRIVLILFLGINLPLFSESPALELSKTVDPIWLILCAALVFFMQAGFLMLETGLSRLKNTINVAVKNLMDYIVGTIAFFSVGFALMFGLSYEGWIGTNHFFLTGLKTGKDFSFFLFQVAFMGTAATIVSGAVAERIKFSAYLIVSVVVSLFIYPVFGHWTWGGGWIAKIGFVDFAGSTVVHSLGGWIALAGVIVLGPRKDKFKEDGTPRKIHGHNLTFSVLGVFILWFGWFGFNGGSALSFTDQVPLIILNTSLAGSVGGIFAITFSWIFYRVASVEDCMNGVLGGLVAITAGCHAFQPYASLIVGALAGISVVITSWVLEKILKLDDVVGAFPVHGVCGIIGTLLLPILSENQDIRIYPQFIGVLTCSFWAFGLGMILFLLLKISIGIRVNEEFEEKGLNVTEHGAGSSWIDLIHSLKDLAKGGGDLTRKIHVDSGTEAGAIAFLMNRYLANLGQMIYTIKEKSIELEYSSSEISVAWGKMSQGIQQQAANLGEVTSIFDSFRESFQTISSSAAQQKEMETSASELLNELVFGFQKFDSDLKNSSEKSEESVKAIDLSRKELNQLETDINDIGSSAKKVEGLVKLLNDISAKLGMLSINASIEAARSGAAGKGFGVVAEEISKLASSTQESTKKASEILGEIQSTVSRGKTTVQTSVEFFKNLTEEFRFLAETYITIRKSSLHYSNLIGNLNRLNTSITNQSEIIMTDIDKRFSEIGNLYESVDLINGAFHEISAQSEELNATGEFLKQLAEILNSLVRNFRVEQNSSQELIPG

SEQ ID NO: 5389 - protein, 441 aa, Mycobacterium tuberculosis H37Rv
MSEVVTAAPAPPVVRLPPAVRGPKLFQGLAFVVSRRRLLGRFVRRYGKAFTANILMYGRVVVVADPQLARQVFTSSPEELGNIQPNLSRMFGSGSVFALDGDDHRRRRRLLAPPFHGKSMKNYETIIEEETLRETANWPQGQAFATLPSMMHITLNAILRAIFGAGGSELDELRRLIPPWVTLGSRLAALPKPKRDYGRLSPWGRLAEWRRQYDTVIDKLIEAERADPNFADRTDVLALMLRSTYDDGSIMSRKDIGDELLTLLAAGHETTAATLGWAFERLSRHPDVLAALVEEVDNGGHELRQAAILEVQRARTVIDFAARRVNPPVYQLGEWVIPRGYSIIINIAQIHGDPDVFPQPDRFDPQRYIGSKPSPFAWIPFGGGTRRCVGAAFANMEMDVVLRTVLRHFTLETTTAAGERSHGRGVAFTPKDGGRVVMRRR

SEQ ID NO: 5390 - protein, 235 aa, Triticum aestivum
  unsure (1)..(235): unsure at all Xaa locations
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQHIEDILLKVSAQXVPDSGPXVTYIGXGGSRNFGKMVQNGIEYGDMQLIGEGDEVLKAVGRLTNGGLEQVFXEWNKGKLLNFL

SEQ ID NO: 5391 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVNGVKVLQLETAAGAAIKFFDHAIGINVPRARFLPVKATSDLLLVKSDLYNVRDGFVIRNKLRRDPQNPVIQLGPEFKKVDDFLSRFKSIPSLLECDGLRVDGDIWFGSGIKLKGNVHCSVSSEEMLNIPDNITLRE

SEQ ID NO: 5392 - protein, 475 aa, Grateloupia turuturu
ERYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPLQTALDLWKDITFNYTSTDTADFVETPTTNV

SEQ ID NO: 5393 - protein, 427 aa, Sirodotia huillensis
IEASAAIAGESSTATWTVVWTDLLTACDLYRAKAYKVDAVPNTADQYFAYIAYDIDLFEEGSIANLTASIIGNVFGFKAVKALRLEDMRLPVAYLKTFQGPATGTIVESERMDKFGRPFLGATVKPKLGLSGKNYGRVVYEGLKGGLDFLKDDENINSQPFMRWRERYLFSMEGVNRAQAATGEIKGHYLNVTAGTMEDMYERAEFAKELGSIICMIDLVIGYTAIQTMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 5394 - protein, 181 aa, Zea mays
SDDGTVCIHQSMHAGLVQGWAAMVMGVLAGSVPWYTMMILHKRSRLLKHVDDTLGVIHTHGVAGLLGGLLTGLLADPTLCALFLPVTNSKGAFYGDGAQLGKQLAGALFIVGWNVAVTSIICVAINAVVPLRMTQDKLEVGDDAVHGEGAYALWGDGELYDVTEHGPRAAAAVAPVSTPPN

SEQ ID NO: 5395 - protein, 484 aa, Thermobifida fusca
MTSHSDGLRRLRNFINGEYVDSVDGRTAPVVNPATGEAYAEAPVSTAEDVDRAFRAAADAFENGWRDSTPAERQIILNKIADAVEERADELVAAEVENCGKPVKATREEEIWQVTDALRFFAGAARVLEGKAAGEYMADHTSWIRREPIGVVGQITPWNYPMAMAAWKIGPALAAGNTIVLKPSDTTPVSTLLLAEIAAEFLPPGVFNVVTGDRDTGRALVDHPIPRLVSLTGSTRAGYEVAQSASRDLKRLHLELGGKAPVIVFDDADVEKAAEGIAGAGYFNAGQDCTAATRVLAAPGIHDDLAAALAEQAKKTKTAGPDETDAYYGPLNNPNQLDRVSGFFERLPDHAEVLTGGSAVDRPGYFFSPTVVSNLRQGDEMVSEEIFGPVITVQRFDDEDTAVAWANSVKYGLASSVWTKDHARALRVSRRLDFGCVWINTHIPIIAEMPHGGFKHSGYGKDLSLYSLEEYTRIKHVMSYIGRD

SEQ ID NO: 5396 - protein, 172 aa, Glycine max
  unsure (1)..(172): unsure at all Xaa locations
MSFTATKFAPSPLPLNSTTPRSNDKPLSFSFDHSKPNPSSSFLGSTRKLLRFNALAKPHAHTRASSSPVAAVLLERTSNLLVTKEEGLELYEDMILGRFFEDKCAEMYYRGKMFGFVHLSNGQEAVSTGFIKLLKKEDSVVSTYRDHVHALSKGGPSRAGMSELXFGKATGC

SEQ ID NO: 5397 - protein, 303 aa, Zea mays
MAGLSLEHPWAFAFGLLGNVISFMTFLAPIPTFYRIYKSKSTEGFQSVPYVVALFSAMLWIFYALIKSNETFLITINAAGCVIETIYIVMYFVYAPKKAKLFTAKIMALLNGGVFGVILLLTLLLFKGSKRVVLLGWICVGFSVSVFVAPLSIMRRVIQTKSVEYMPFSLSLSLTLSAVVWFLYGLLIKDKYVALPNVLGFIFGVVQMVLYVFYMNKTPVAAAVGKDAGKLPSAADDHVLVNIAKLNPALPERTSGTMMHPVTQMAAVPARSCAAEATAPAMLPNRDVVDVFVSRHSPAVHVV

SEQ ID NO: 5398 - protein, 293 aa, Tropheryma whipplei str. Twist
MLPKRAYPVQDSNVHSQEKKIIAGNWKMNINHSQAVSYLQELNWRLIDNGHDFDSCEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 5399 - protein, 329 aa, Glycine max
  unsure (1)..(329): unsure at all Xaa locations
MAATTNKDEAISTSASSSSSPVFISTETLCTILTHHTLMNHLQSTLPKASTILQTPIRQHHSLSPSSSLLLMPSWSSSPSLPYIGVKLVTHFPQNSSINLPGVQGSYVLFSSTTGQTLASMNSTELTLYRTSCVXGLASKYLARHDSEVLVMVGASSLAPRLIKAHLSAIPSLRKVIIWNRTVGKATNLVKXGEFGGVSFEGCGCLDEVVGFGDIVSCATNSETPLVKGVRLKGGAHLDLVGSFKPSMMECDDEAIRRGKVFVDNEAALVEAGELVGAFERGVIKRDEIGGSLVELVRGDKVGRSSFEQITVFMSVGSAVVDMLAAVCL

SEQ ID NO: 5400 - protein, 536 aa, Triticum aestivum
  unsure (1)..(536): unsure at all Xaa locations
MHASYVMYVTYHNKTPRTPPPPPSLPMATPPRLPSLPLLLALCPAAAGGLRPPPAAHVPRAQARRLAGAHNPLPRACRGRRLAAGAEGGAPGEPLERRVTRPGRPEGVGDRGRHDGRRRLPNPHGPRQLXFWFEYRAKKKGALVPGATGGPACXAELARTPAARPLCLDQPVSYLYHLCRRPQQFSVRMVFRATRYGHGPWSSEPRSRSDRGWGSQDLLGILHVFFKKPPEFVKNDPFIARDTYALPENPNFALLVHEAKSRNEENHINYKGSAIFNRLTAPAIXYTDSADYALDKNLFPKAHKDRFSKIIPPRRFTTPHHGKHPKKSGIPAGRPLATXYSSSLKLSATLPCTPFVPSPLGTLGYGSTGMAKTFAQKXNQTGDWSGLRQARVVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYAAM

SEQ ID NO: 5401 - protein, 813 aa, Streptomyces rochei
MKRRIWVPSVFLTVLALLNLGSAPASSGTGESRVDRLVDQMTLDEKLSFVHWDYSTTDPTALVYLPGVPRLDIPEVRASDGPAGVTIHRPSLAMPAPVSLASSFDDGLAEKYGQVLGREGRAFGMDVLFAPMVNDIRVPQAGRNFETFSEDPLLTGRTAAAEVTGIQSQGLMATVKHYAANTQENNRMGVDVEVDDRTLHETELPGFEAAVGAGAAAVMCAYPRVDGEPACGSDTLLTGILREQLHFQGFVTSDWLATHSTDAITKGLDQELGIDSTTAIPPGGQVPGGKYFGDTLKKAITDGTIPVSVLDRSVRRILGQMDRFGLLAENKPPRPQRDLAGGTRVARQVAESGAVLLRNQDRMLPLDAAATDHLAVIGPTAKTPKVTGLGSSYIVPDTATAPLDAITAKLGRGAQVSYAEGEDVEGEPIPAAAFEPPFSGGTVLQPARSGVVYDGRLTVDKAGLYRIAARVTGGNGSLQIDGGDPVSFGEVFGKLTSVPLRLSAGTHTVKISGGALVDQPMRLDLSWVTPARAQEAIDQAVETARKATTAVVFAYDDGAEGSDRTSLSLPGYQDELIKAVTAANPRTVVVLNTGSSVTMPWLDKTRAVLDMWYPGQAGAEATADLLFGDAEPGGRLSQTFPASDQATPVAGDHARYPGVDGVVHYSEGIYSGYRWYDHEGVKPLFPFGFGLSYTSFAYEDESVTRTADGLDVDVTVRNTGDRPGSDVVQVYLGPSPRLALDQADKALAGYRKVALDPGESRRVRIHVAERALQYWDTSGGAWKLAGGERRVLVGSSSDRIRLTATAQTDRPGR

SEQ ID NO: 5402 - protein, 272 aa, Methanosarcina barkeri
MPKEMLPIIDTPVIQYVVEEAIASGIEDIIIITGRGKRAIEDYFDDSPELEMHLAKKHNTELLKLVRNVSSLVDIHYIRQKEPNGLGDAVLRAENHIGDEPFAVLLGDDIIVNNKPCTAQLIDNFEKYGRSTLAVEEVPREKLSSYGIIKGKPLSNSLYVLEDIVEKPSPENAPSNMGAIGRYVFTPEIFDCIKEAGTGVGNEIQLTDGIRVLNRSQMIYACRFKGKRFDTGDRLGYVKSIVDFALENENLREDVLEYLREILAEVKEPSSK

SEQ ID NO: 5403 - protein, 368 aa, Marsilea quadrifolia
QTAASRPLSVKATATEIPSKVHKSSSKNVVRIGINGFGRIGRLCLRVALARDDIEVVAVNDPFIDTKYMAYMFKYDSTHGIYKDEIKAVDESTLQIGGQRVKVFGKRDPSEIPWGSAGADFVVESSGVFTTIEKASSHLKGGAKKVIISAPSADAPMFVMGVNEETYKPDMQIVSNASCTTNCLAPLAKVVDQEFGIVEGLMTTVHATTATQKTVDGPSGKDWRGGRGAAQNIIPSSTGAAKAVGKVLPQLNGKLTGMAFRVPTPNVSVVDLTCRLEKGASYDDVKAAVKAASEGSMKGILGYTEDDVVSTDFVGDSRSSIFDAKAGIALNKNFIKMVTWYDNEWGYSNRVVDLISHIAAVVAANKGN

SEQ ID NO: 5404 - protein, 367 aa, Bacillus megaterium
MTKKVAVLPGDGGQSNQRRCCRLKAIGERLRHQFEFTYGLIGGAAIDEAGSSSSRSTIETCNEADAVLLGSVGGPKWDRFPSHLRPEKGLLAIRKELDLYANLRPVTFYDSLADASPLKKEYIEGVDFIIVRELTGGLYFGKPSDRRTEGNKETVVDTLFYKRTEIERIIASIDTAVNRRKKVTSVDKANVLESSRVWREVAEEVAKDYPDVELEHMLVDSAAMQLIRNPKYFDVVVTENMFGDILSDEASMLTGSLGMLPSASLTADGPSLYEPVHGSAPDIAGQNKANPIAAAILSAAMLLRHSFGLEKEAAVIEQAVESVLHAGHRTADLADGNHYLGTDKMVEVITAVIANDSAISSIMTASR

SEQ ID NO: 5405 - protein, 452 aa, Bradyrhizobium japonicum USDA 110
MSMISARIERLPFARFHKHLLLMGGLGYMFDAMDAAVLAFILPVLRTAWNLSSVQIGVLGSSTYIGFLFGALLAGTLGDLIGRRAVMMSALALYCAASIVSAMVDTWPSFFAARVVAGMGTGAESAIVAPYLAEFVARRYRGSFTGALAGFFSFGFVAAALLGYFIVPAYENGWRIVLVITAVPVVMLLWWRRALPESPRWLESRGREKEAEALLDTIEAGFARQGHVLPHPVVEAVAPQGATGTLLANFAALLAGRQARITIMTWIMWLAITFSYYSFFVWIPGLLVQNGMSITKSFAYSIAIYCAQIPGYFSAAYFNERIGRQATIATYMVLGGASALGLAFAQSDQQIMAAGIFLSLFMNGTYAGVYAYTAEVFPTPVRTTGAGLASAIGRIGAIVSPILVGYLYPNFGFAGVFGVTTTVLLLGAVTVVLMGVPTRGRSLEEIAAGEVA

SEQ ID NO: 5406 - protein, 407 aa, Flaveria trinervia
MESRVLSSGATAISGVPRLTKPAGRITTTTVAVAFPARLNATGGNVVWGRQLRPSLLNLDHSSPVSLVTKPVKRDVLKPCSATASDSAGDAAPVGFLAKYPFLVTGFFFFMWYFLNVIFNILNKKIYNYFPYPYFVSVIHLAVGVVYCLGSWTVGLPKRAPVDSNILKLLIPVGFCHALGHVTSNVSFAAVAVSFTHTIKALEPFFNAAASQFVLGQSIPISLWLSLAPVVIGVSMASLTELSFNWLGFISAMISNISFTYRSIYSKKAMTDMDSTNLYAYISIIALLFCIPPAVLFEGPQLLKHGFNDAIAKVGMIKFISDLFWVGMFYHLYNQIATNTLERVAPLTHAVGNVLKRVFVIGFSIIVFGNKISTQTAIGTSIAIAGVAIYSLIKARIEEEKRRMKSA

SEQ ID NO: 5407 - protein, 357 aa, Glycine max
MNMLSNRVLLCYFSACEHYLLSVSFFLFSLSSFHIYMYNSFCLSSILFFFFHSFLHSSLKFPILKPSPRERVSTHNPQQREQQQPYTLSTSYSPPCLPPHFFSFPFTKSMDFLVGPTFTIDVASSPPPYDADLPGVATAADRPYGLFSGHSSDSESSIGTPDDSDDDENDVVSSKRNQSDEDEDKEEEEEEEVHSKLKGLASLDSLEDSLPIKRGLSNHFMGKSKSFTDLSQVNTLNTVKELQKQENPFNKRRRVQIATKLTRKSSFYAWSNPKSMPLLPVHEDEDNFLEEEEKPKKVSPSSSSSYSSEENKQDHVLVPKSYVDHMRARFGSFKSRSLSDLKEHDEEQEQEDDDDDA

SEQ ID NO: 5408 - protein, 175 aa, Triticum aestivum
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5409 - protein, 436 aa, Haemophilus influenzae Rd
  unsure (1)..(436): unsure at all Xaa locations
MAKIVKVIGREIIDSRGNPTVEAEVHLXGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKAKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 5410 - protein, 308 aa, Shewanella violacea
GTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 5411 - protein, 328 aa, Zea mays
MLQTMALFFIFLMWSTMMISLLPVVVTKMSASEVNGSKLSPEELVVLQGCPCPPSRLRPGFYWYDKVSGFWGKEGHKPHCIITANLNVGGSLDQKASNGNTGILINGREITKSELQMLKLAGVQCAGKPHFWVNADGTYQEEGQKTVKGKIWDKPIVKLLSPVLSLPTPNKAANQSSEDAVDIVNRAIPDYLEQRTTQKLLLVGSGASTILKQAKFLYKTGKPFSVDEREDLKLIIQSNIYNYLGILLEGRERFEEESLADRRKTSQCDPSSSGCCEPGLSDEVTEYSLIPRLKAFSDWILKAMALGNLEDIFPAASREYAPLVDEFM

SEQ ID NO: 5412 - protein, 314 aa, Sinorhizobium meliloti
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFP

SEQ ID NO: 5413 - protein, 667 aa, Nicotiana tabacum
MAAAAPSPSSSAFSKTLSPSSSTSSTLLPRSTFPFPHHPHKTTPPPLHLTHTHIHIHSQRRRFTISNVISTNQKVSQTEKTETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPILIDVPKDIQQQLVIPDWDQPMRLPGYMSRLPKLPNEMLLEQIVRLISESKKPVLYVGGGCSQSSEDLRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTEQKVKHPLNFKTFGDAIPPQYAIQVLDELTNGNAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGVPAARVTHRDDLRAAIQKMLDTPGPYLLDVIVPHQEHVLPMIPSGGAFKDVITEGDGRSSY

SEQ ID NO: 5414 - protein, 355 aa, Colletotrichum lagenarium
MSRANAPNPSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 5415 - protein, 357 aa, Triticum aestivum
KQTDNSQRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGMEAGATSNMKFAMNGCILIGTLDGANVEIREEVGEENFFLFGAHAPEIAGLRQERAEGKFVPDPRFEEVKEYVRSGIFGTGNYDELMGSLEGNEGYGRADYFLVGKDFPSYIECQEKVDEAYRDQKLWTRMSILNTAGSPKFSSDRTIHEYAKDIWGISPVIMP

SEQ ID NO: 5416 - protein, 85 aa, Glycine max
  unsure (1)..(85): unsure at all Xaa locations
MATIVSXKARQIFXSSWXNPTVXVDXTCSDGXFARAAVLXGXSTGIYEALELRDRGSDYLXKGVSKAVDNVNTIIXAPAXVGKXP

SEQ ID NO: 5417 - protein, 413 aa, Oryza sativa
MEEQQQVEVEVEVPSYFVCPISLQIMRDPVTLPTGITYDRDGIERWLLTAGTCPLTKQPVPPDCDPTPNHTLRRLIQSWCALHADHGVDLVPTPKPPADRARVADLVSRLRAATSSAALLDALRELRDVAAESERNRKLLAAVPGAVDVLAAVVVASCRDAKAACDEALEIVCSLELSERCLARLVERNEELVDALVATLQRTNTTSRAHAALLLEAVTAVMPSNRLVSLPEEVFGEAVQLLRDRVSSPATRAALHVLVGTTSWGRNRVKAVDAGAVAVLVDMLLDGPVERRGCELALAALDRMCGCAEGRAALVSHGAGVAVVGRKVLRVSEVASEKAVRVLRSVARHAATAAVVQEMGQTGAVEKLCVVAQSEQCGERTRERARETLRLHARAWRNSPCLQPHLQALYPSC

SEQ ID NO: 5418 - protein, 233 aa, Cicer arietinum
NNDGSDYGSWEGGSYLHDDGDDFDDLHDGTDVDEDDDEDDDNEDEYENEDAFDVHAHASAGEHDNPIIEFDPELFSSDEAYARALQEAEEREMAARLLALAGINDLSFSITEETEDMEEHGANSQDAWEDVDPDELSYEELLALGEVVGTESRGLSTDTIACLPSVNYKTGSDQHGSNDSCVICRVDYEDDESLTVLSCKHLYHPECINNWLKINKVCPVCSTEVSASSGSNL

SEQ ID NO: 5419 - protein, 408 aa, GIBBERELLA ZEAE PH-1
MMRPMLARSALRSARLSSFRPLCQAQRFSIKAEAASSAQHMGLDASKLTIQKTGNHKTLSKPETLVFGKEFTDHMLAIEWNQDKGWLEPKITPYQNLSLDPATCVFHYAFECFEGMKAYKDKNGKVRLFRPDMNMARLNKSAARIALPTFEPAEFAQLISKLVNLDSRFIPDQRGYSLYLRPTMIGTQKTLGVGPPGSALLYCIASPVGPYYPTGFKAVSLEATDYAVRAWPGGVGDKKLGANYAPCILPQLQAASRGFQQNLWLFGEEEFVTEVGTMNMFVALKNKETGQKELITAPLDGTILEGVTRDSVLALARERLIPQGWKITERKYTMKELAEAADEGRLLEAFGTGTAAIVSPVRSISWKGKLVDCGLSEVEESGEIALQMKNWIEAIQYGDEEHEWSYTI

SEQ ID NO: 5420 - protein, 639 aa, Oryza sativa
MAFYNGASVVALLLLVSTAARAAGDGLLLNGNFEYQPSKSQMNGTRVMAEYAIPYWKITGFVEYISSGQKQGDMLLTVPEGAHAVRLGNEASIEQQISVTRGMYYSITFSAARTCAQSEKLNVSVAPGPESGELPIQTVYTSSGWDSYAWAFKAKRGLVSLIIHNHGEDDDPACGPLIDSVAIKTLYPPQATQNNMLRNGDFEEGPYMFPNAAWGVMVPPISEDDHSPLPGWMVMSDTKAVKCVDSAHFTVPHGARAVELVSGLETALMQEVRTVPGRSYRLEFSVGDASDGCVGSMQVKGYAGQGCTTVTYSSQGTGGHTRASLEFAAVANTTRVVFVSSTYITKWDGTLCGPVVDDASLPRGRDGADKRALPVGDSREAGAPWTKSTHALVRGRTTWQTRGGHDGRVGGGGADVAPRGHPRRAAQGGHVDGPDRLGRPIERSRAGAARQRGRAAVGEQGGGDRPESGGARPDGRRQRAAAALEAAAHTGGGGEGRGAHRDGGDGEAKAGRRPTTRIGGGASRVGVGDGALTTPDRCGGTAEGQQDLGKGMAGLGRHEETPGGGAVAEDLLVLAEPREATAWVGDDQSSGTTQLQSAHGGGGSGRRWRGGYGGDLGKRSGCRYVARHSEPFGGGGAAR

SEQ ID NO: 5421 - protein, 145 aa, Thermoanaerobacter tengcongensis
MSLMRRGRDWWDWPFDINIRNLPSIFDINFPSLSGLFSRPRVDIVESETEIVATAELPGVDKKDIEINVYDNILEIKGQTSVDEEKEDKNYYIRERYYGSFARRIELPAEVDPERTTAKFENGILKITMPKLHPSKPKKRRIDIE

SEQ ID NO: 5422 - protein, 166 aa, Triticum aestivum
  unsure (1)..(166): unsure at all Xaa locations
HFRQFRSPHRTTTGSHGTHRQSLGVGDIEFVSCSPTVYQAMLLDWMRNLEVGIPELLENDIKVLIYAGEYDLICNWLGNSRWVDSMEWSGKKAFVSSVEKPFTVDGKEAGILKKAXGPFXFLKVHWFLVTWVPMDQPKAALEMLKRWMSGNLSDASPSSQRLDFAI

SEQ ID NO: 5423 - protein, 316 aa, Sorghum bicolor
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 5424 - protein, 491 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIPLRRRVAHPKVSPELRAIWVNYLSQCDESLGVKIANRLNVKPSM

SEQ ID NO: 5425 - protein, 196 aa, Glycine max
  unsure (1)..(196): unsure at all Xaa locations
RSLGKILPKKIVNMSSPLIHEIKGQAFRFLKEKIKTARLALTDVTPVQLMTEEATNENPWPPDTRSTSIIARAAFEVDEYERIIEILHHRLLKFDKGYWRASYKALILLEHLLTHGPKRVSEEFQCDIDVIEEIGQFQFIDEKGFNWGLRVXKLSERILKLLRNKDFFTEERARARNLSHAIKGFGSFNQRSSAID

SEQ ID NO: 5426 - protein, 321 aa, Listeria ivanovii
MYKLRSRQVLVVLLCLVCYIITFPSAGKAHSIKNSYRTAQSSITTKQWMSALPDNTKLTSLTIPGTHDTMSYKGNISWTLTKSLAQTQKMSLFQQLEARIRYIDIRAKEDLQIYHGPIYLDASLKGVLETTVNFLKEHPKETIIMRLKDENNHKNDRFDYRIQPLINQYKAFFYTTPKSDSSDKFPTLKELRGKILLLLENGTNKPLTINYSKFGMKFAAENQVIQDNFNGPTIKTKYNEIVQTAHQAFKQSSGENKLYLNHVSATSLTCTPYQYASTLNAKVDQYVTKLTAVGVRGLGVFIMDFPPKQTIKSVIKNNKFN

SEQ ID NO: 5427 - protein, 74 aa, Zea mays
RSQSRLQDLHHGAANQQNAAHQKAQDNPNQEAEDRRQIMLAQILSSEAGKRLSGLALVKPDKPGGGEDVLLKAA

SEQ ID NO: 5428 - protein, 388 aa, Eremothecium gossypii
MPNADLEIKTINPDLEASQFIIQPPAVQSGDGENVATDESQRGDVSSSVSSQKSTSLPRIKIIGTGGTIASKGSSSSQTAGYHVDLTIQELLEAIPDISNICEIEYEQLCNVDSKDINEEILLKLYSCISESLQRFNGIVITHGTDTMAETAFFIESTIDSGSVPIVFVGSMRPSTSVSADGPMNLYQAICIASNAKSRQRGVLVSLNDQISSGYYIIKTNANTLDSFNVRQGYLGNFVNNEILYYYPPAKPLGCHKFKLPLQPGQTSLNLPKVVIIYSHQSISPILVELAGKRCKGVVIATMGAGTLPEAVNSACMQLTIPVVYSKRSMEGMVPVANLPLPPSDPRSKIIASGYLNPEKSRILLQLCLNQDYSIDLIRQVFRGVYGG

SEQ ID NO: 5429 - protein, 1029 aa, ASPERGILLUS NIDULANS FGSC A4
MTGSECQPRHSASSGTGRDIHTLSWDGDHDPANPFNWSISRKWAVTYLAALISFLTMMNGTIITVAHFEIAELFNIDETAFPHTYWPVTTWAVGGAFSALFLLPLAEDFGTRPVFLVTYFAFVCFLIPQAVAQNFATLVATRFFAGACVAILANTAAGVIGNVWDTEWSRSIPVSLYIFGYMAGSSMGPVIGAAVLQSLSWRWIGYMQLIWFGALFPIYYFFFYESRGDIILAQRDRKMGKNGKDILPGHPAHSKLNLQNLAVSSTRPVILFCTEPVLFVSTLWSAFTVGTIFLFTQSVEQVFIGTYDWTISKTGYVQAAVVIGEGIGFFFSFLSRELYFASASRNTEVPNSLIPEARLYMAVLGGLFGISGGMFTYAWTSYPFIPWIAPAISLAMVGAGSVLVVTGVSDYVVDAYSQYAGSAIGAVATGENIFSAFLPLATMSMYNNLGFQWASTLLAFVSLVLALVPTLMFVWGRELDNYALPTIATYAYSPANHYCTTQQAFQCHCSNFPSLHSCPTTTRHRPTNHLLKMPSLANTLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGLALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPFGGVKHSGMGREGSKYGIDDYLNIKTIVTGGIHTAYSAHL

SEQ ID NO: 5430 - protein, 157 aa, Zea mays
  unsure (1)..(157): unsure at all Xaa locations
MATAVAAPVSVAPSPAPKANDSRKAVVPVDTSELEKHMLAVDDSSVDRAVIARILCGSRYRVTAVESXTRALELLAMGLLPDISMIITDYWMPGMTGYELLKHVKESAAPRGIPVVIMSSMTIVIYTFSNKILRYHLLHFTLPLKSKCHIHRYKTYC

SEQ ID NO: 5431 - protein, 296 aa, Arabidopsis thaliana
MFAVENISMEFEPAINESSSSLSSSRSSCGHWYVRYGVCIACKSTVNKRHGRAFDYLVQGLQLSHEAAAFTKRFTTQFYCLNEKKLNLVLDLDHTLLHSIRVSLLSETEKCLIEEACSTTREDLWKLDSDYLTKLRPFVHEFLKEANELFTMYVYTMGTRVYAESLLKLIDPKRIYFGDRVITRDESPYVKTLDLVLAEERGVVIVDDTSDVWTHHKSNLVEINEYHFFRVNGPEESNSYTEEKRDESKNNGGLANVLKLLKEVHYGFFRVKEELESQDVRFLLQEIDFKLLTKDA

SEQ ID NO: 5432 - protein, 403 aa, Zea mays
MATALGGEPNPTADAMEVDPPRASADEKHVATIIAGGSDAVTGHIISTTIGGKNGEPKRTISYMAERVVGTGSFGVVFQAKCIETGETVAIKKVLQDKRYKNRELQIMRSIDHCNVISLKHCFFSTTSRDELFLNLVMEFVPESLYRVLKHYKDMKQRMPLIYVKLYMYQIFRGLAYIHTVPGICHRDIKPQNILVDPLSHQVKVCDFGSAKILIKGEANISYICSRYYRAPELIFGATEYTTSIDIWSAGCVLAELLLSQPLFPGESAVDQLVEIIKVLGTPTREEIRCMNPNYTEFKFPQIKACPWHKIFHKRMPPEAIDLVSRLLQYSPNLRCSALEACAHSFFDELRESHARLPNGRPFPPLFNFKQELANAPPELVSRLLPEHARRHSGFGSLFGSGP

SEQ ID NO: 5433 - protein, 168 aa, Desulfovibrio vulgaris subsp. vulgaris (strain Hildenborough)
MTSEGYALAWVTLSDKGAQGQREDASGPCIAAMVRESIPLRYEQGFMLPDDGAQLRALLTELALVQRYDIIITTGGTGLGPRDVTPEATSAVIEKRLQGFEQAMLAASLAKTPHAVISRALAGTLGGAIIINLPGSRKAVAENLEAVLPALPHALAKLQGDPSDCAQA

SEQ ID NO: 5434 - protein, 623 aa, Oryza sativa (japonica cultivar-group)
MLRRCVRDLYPLRPLRRIPRPISSEVPSPAFLRPRSKSTKASQQSSTQNTVPGPQGEPSQSGSNVPKVLLGTLMVGAAAMAAYQAGYIDDQFKDIIFPSTMKEKNIRKIYDDLKAPSEQKVDEKQVVSDPNVDIVQNSNNEAHPQKDLPTEGMGPPEIPTTDEQTVSSEEKEKETLAQGTPQIPDEHGAAAKPLSQDIPVIDINPSVDDKATGEVLPEQTDKTTTSVSPVQSSLATAGPSHHVHTDTDGPKDPSSAGAVEHKSLAETYLLQEPDNSKDMGAKESKHDGVISTGTSDDGKIVLDIIEAIHAAERKQADADAYMYSEEKRKLKEKYEKELKAPGLGSSCMLKSSNSGKELKKEKLKSAAVIKELQENAEQKLRDELQQKDEETSQQVEKVRELAKAELAAALAKERASQIEQIAEANLNIDALCMAFYARSEETRQSHSVHKLALGTLALEDALSTGSPIRTEVDQLRKSLEGIDKDSLLELALSSIPEDVLEYGSDTPMDLKQKFNSLKETVRHFSLIPAGGVGMLTHAVAHVASSIKIKEDQSGDGIESLLNRVENLIIHGDLSAAAEALERGLQGSEAAEIASEWVKQARKRAIAEQTLTLLHSYASSITFS

SEQ ID NO: 5435 - protein, 388 aa, Oryza sativa
MDQKQDEILKKDRAELLQAQAELWCHTFGYLKSIALRCAVELGIPNAIHRNGGSASLPELLGTLPLAANKRSCLPRLMRFLVSFGIFKEDISREGTTTTTSVYQLTPVSRLLVDASSRGIFVLGNWLTSSDENTPFGMAHGMDFWDFTGHDAEYSMLFNKGMASDSHFVVNIVIHECAEVFVGVRSLVDVGGRNGAMAKAIADAFPHIKCYVLDLPHVIHGTPTDGIVEFVAGDMMHFVPSADVVLLKFVLHDWSDEDCVRILTRCKQAITNKEEGGKVIIIDTVIGSPSQQILEAQLSMDICMMTLTTGKEREERDWHKIFLEAGFTRYKIMPILGVICDGSKSLSSTGLSLCHRLVITDDLTSPVTVEGPSMVRDTYDGLQLATIS

SEQ ID NO: 5436 - protein, 282 aa, Lotus japonicus
MTGREILHKMKEKVLGSSDPDSGKGKSKMSKNITHGYHLVKGRSDHAMEDYVVAQFKTVDNNELGLFAIFDGHSGHNVPDYLQSNLFDNILKEPDFWTKPVEAVKKAYVDTDSTILEKSGELGRGGSTAVTAILINCQKLVVANLGDSRAVLCKNGEAIPLSVDHEPATESEDIRNRGGFVSNFPGDVPRVDGQLAVSRAFGDKSLKKHLSSEPHVTVELIDDDAEFIILASDGLWKVMSNQEAVDAIRNVKDARSAAKNLTEEALKRNSSDDISCVVVRLQ

SEQ ID NO: 5437 - protein, 561 aa, Zea mays
MATPDDRGSWLLYLSLAAKCAGDQPYRLTGFLAVCAVAFVVTCLLHWCFPGGPAWGRWWWTRRLGAGAGGGATAAAAALPGPRGLPVVGSMWLMTGLAHRKLAAAAGSLGARRLMAFSLGGTRVVVASHPDVAREILSSPAFADRPIKESAYGLLFHRAIGFAPYGAYWRALRRVASTHLFSPRQVAASAAQRAVIARQMVGAVKELSAASPGRRGGVEVRRVLRRGSLHSVMWSVFGRRYDLELDPARESPETRELRRLVDEGYDLLGQLNWSDHLPGLACLDLQSTRARCDRLVPLVTRFVGGIVDEHRARNHLRSAPPAVVDFTDVLLSLPADDRLTDADMIAVLWEMVFRGTDTVAVLMEWVLARLVLHPDVQARVHDELDRVVGPDRAVTESDTASLVYLHAVIKEVLRMHPPGPLLSWARLATSDVHVDGHLIPAGTTAMVNMWAITHDPDVWAEPTEFQPERFMGSTEFPIMGSDLRLAPFGAGRRSCPGKSLAMATVAFWLATLLHEFELLPSPVDLSEVLKLSCEMAVPLALAVTARPRQAVQKSVGVSVSL

SEQ ID NO: 5438 - protein, 357 aa, Schizosaccharomyces pombe
KWFRYIFRVSVAVILLDFVLNMIWLPIAVSTKYGFRDEAFMKSTNYDLGKVNNGWSWCLTFFCTARILVGYDAAGHVAEETKNASKTASRGMFYSDFSNAILSTGIIRHVFIYCLPSNVMYELIKSNSQQPFVSFYAYALGKRAHVFMNVVGILGMIFDTSLSIVASSRLVFAVGRDGVLPFSGWLRKVDSHGQPTNAVTFIFLISAALLCSNLASAVAFTSLLSDAAVPTIMAYAAVAFGRLFLSRNDFPKSEWSLGKLSKPFQLITFLWNLFTAVILFSPKAYPVTGKNFNYAPVIFGAITIFGLISWLSIPASRWSTFYDASKLDSNSFDDSSSDKKSLEKAASIAEGSITQII

SEQ ID NO: 5439 - protein, 322 aa, Schizosaccharomyces pombe
MATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAGVLSIYDQVQLLMFGKKF

SEQ ID NO: 5440 - protein, 339 aa, Zea mays
IRLEDQPTGTGFSYSTDKRDIRHDEEGVSNDLYDFLQAFFAEHPEYVKNDFFITGESYAGHYIPAFAARVHRGNKAKEGIHINLKGFAIGNGLTDPGIQYKAYTDYALDMGIIQKADYERINKVMVPACEMAIKLCGTDGKIACTASYFVCNTIFNSIMSHAGDINYYDIRKKCEGSLCYDFSNLEKYLNQKSVRDALGVGDIDFVSCSSTVYQAMLVDWMRNLEVGIPALLEDGINMLVYAGEFDLICNWLGNSKWVHAMEWSGQQEFVVSSEVPFTVDDSEAGLLKKYGPLSFLKVHDAGHMVPMDQPKASLEMLKRWTQGTLSESAADAEKLVAEL

SEQ ID NO: 5441 - protein, 175 aa, Triticum aestivum
MAPTVMASSATSVAPFQGLKSTAGLPVSRRSTSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 5442 - protein, 235 aa, Triticum aestivum
MADKENSAYAAAAAPRTTRASAKRAAAVTAVAVAAKRKRVALSEIPTLPNGAPQPQTKPKKSSSQVAKPKKRSVSSLSLSLPAPKPAPGAADETGDPQLCAPYASDIYSYLRSMEVQARRRPAADYIERVQVDVTPNMRGILVDWLVEVAEEYKLVSDTLYLTVSYIDRFLSANSLNRQKLQLLGVSAMLIASKYEEISPPNVEDFCYITDNTYMKLRLGQSDRHVLPHPVHKIW

SEQ ID NO: 5443 - protein, 482 aa, Oryza sativa
  unsure (1)..(482): unsure at all Xaa locations
MSSSLASRRSSSSRAAKRPAAGEGGGKAAAVAXGGQAPGKAGNAKLNLAAXAAPVKKGSLASGRSVGXTNRASAVKSASTKPAPAISRHESAAQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 5444 - protein, 258 aa, SYNECHOCOCCUS SP. WH 8102
MPQWISTPERGSLYQWLPRSLKSPRIPRYFYMSTKPLVISPSILSADFSRLGDEVKAVDEAGADWIHVDVMDGRFVPNITIGPLIVEALRPVTQKPLDVHLMIVEPEKYVPDFAKAGADIISVQVEACPHLHRNLAQIKDLGKLAGAVLNPSTRLDTLEYCLELCDLVLIMSVNPGFGGQSFIENQVQKISDLRRMCDERGLDPWIEVDGGVKAGNAWKVIEAGANAIVSGSGVFNQPDYAEAIKGIRNSSSKEAVLV

SEQ ID NO: 5445 - protein, 464 aa, Gelidium crinale
KWGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 5446 - protein, 457 aa, Sphacelaria tribuloides
  unsure (1)..(457): unsure at all Xaa locations
DYNVKDTDVLALFRITPQPGVDPVEAAAAVAGESSTATWTVVWTDLLTACDIYRAKAYRVDPVPGTSDQYFAYIAYECDLFEEGSLANLTASIIGNVIGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRASAATGEVKGSYLNITAATIENMYERAEFAESVGTVICMIDLVIGYTAIQTMAIWARKAQLILHLHRAGNSTYARQKNHGINFRVICKWMRMCGVDHIHAGTVVGKLEGDPLMVXGXYNTLLLTELKVNLAEGLFFDMDWASLRKCVPVASGGIHCGQMHQLLYYLGDDVVLQFGGGTIGHPDGIQSGATANRVALEAMVLARNEERDYVSEGREILRDAASTCGPLKAALDLWKDITFEYTSTDTPDFVEVATQSK

SEQ ID NO: 5447 - protein, 159 aa, Escherichia coli
  unsure (1)..(159): unsure at all Xaa locations
AXKLISNDLRDGDKLPHRHVFNGXGYDGDNISPHLAWDDVPAGTKSFVVTCYDPDAPTGSGWWHWVVVNLPADTRVLPQGFGSGLVAXPDGVLQTRTDFGKTGYDGAAPPKGETHRYIFTVHALDIERIDVDEGASGAXVGFNVHFHSLASASITAXFS

SEQ ID NO: 5448 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRDQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 5449 - protein, 281 aa, Desulfitobacterium hafniense
MVTTFLMGSSFAVVKIGLIYSSPLLLAALRFILAGGIMGIIVGVLKRTHPTTKDQWVKLLIIGAFQTAGVMGCIFLSLRTITASESAILTFTNPLLVVLFSTVFLKMRYRLYQWIGVILGLVGVSITMGAQIEFRIGVFFGILSAVFWAIATLLTKRWGGLTDIWVLSAYQMLFGGLILWVGSFILETPFFTVNGTALLILLWLSLISSIVQFALWYYLLQKGEPGKTSAFLFLAPFFGVLTGWLLLGDPLYPSLLAGGLLIIIGIFLVNKDFNHKRVSAN

SEQ ID NO: 5450 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 5451 - protein, 296 aa, Escherichia coli K12
MSFFHASQRDALNQSLAEVQGQINVSFEFFPPRTSEMEQTLWNSIDRLSSLKPKFVSVTYGANSGERDRTHSIIKGIKDRTGLEAAPHLTCIDATPDELRTIARDYWNNGIRHIVALRGDLPPGSGKPEMYASDLVTLLKEVADFDISVAAYPEVHPEAKSAQADLLNLKRKVDAGANRAITQFFFDVESYLRFRDRCVSAGIDVEIIPGILPVSNFKQAKKFADMTNVRIPAWMAQMFDGLDDDAETRKLVGANIAMDMVKILSREGVKDFHFYTLNRAEMSYAICHTLGVRPGL

SEQ ID NO: 5452 - protein, 304 aa, Glycine max
  unsure (1)..(304): unsure at all Xaa locations
DETPLLYSLVFGEGVVNDATSVVLFNAIQSFDLNLIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITXVVLFSTVVFGLLTKPLIRLLLPHTPHHKESSISITTDPSTPSPKSVTV

SEQ ID NO: 5453 - protein, 433 aa, Zea mays
  unsure (1)..(433): unsure at all Xaa locations
ASGRTKHAARTRMAIVREEAVDTSISPRVSALRPSKTMAITDQAMALRQAGVPVIGLAAGEPDFDTPPAIAEAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDEINEKSRLLILCSPSNPTGSVYPKELLEKIADIVKKHPRLLVLSDEIYEHIIYQPAKHISFASLPGMWERTLTVNGFSKAFAMTGWRLGYLAAPKKKKXHFVAACGKIQSQFTSGXASSISQKAGLAALNLGYAGGEAVSTMVKAFQERRDYLVKNFKELPGVKISEPQGAFYLFIDFSAYYGSEVEGFGTIKNSESLCIFLLEKAQVALVPGDAFGDDKCIRISYAASLTTLQTAMSKLKEAVALLKPCVAA

SEQ ID NO: 5454 - protein, 175 aa, Glycine max
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIDFQPPGCEESAKA

SEQ ID NO: 5455 - protein, 152 aa, Triticum aestivum
  unsure (1)..(152): unsure at all Xaa locations
MDAAGARPSAPSAAAAAVAGASVADEPRDARVVRELLRSMGLGEGEYEPRVVHQFLDLAYRYVGDVLGDAQVYADHAGKAQIDADDVRLXAIHAKVNFSFSQPPPREVLLELXRSRNRMPLPKSIAPPGSIPXPPEQDTCWPTTNPAPFNRN

SEQ ID NO: 5456 - protein, 307 aa, Triticum aestivum
  unsure (1)..(307): unsure at all Xaa locations
MASRTAGRGGRPLLGGGAGGGRRGKPSKAIMAALLLASVALLLLLALGALSLPAGSGRGAVLSLPRPRFRRSAFXVEAGEARGKKGEPWTEVLSWXEPRAFIYHNFLSKEXECHYLISLGKXPHMKNVDSRLMXATARSKDIRVRNEFTEHFLSRCQDKIVRTIXEKRISDFTFIPVENGEGLQVLHYEVGQKYEPHFDYFHDDFNTKNGGQRIATVLMYLSDVEEGGETVFPSAKVNSSSIPFHNELSECAKRGISVKPKMGDALLFWSMRPDGTLDPTSLHGGCPVIKGDKWSSTKWIRVHEYKV

SEQ ID NO: 5457 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 5458 - protein, 663 aa, Oryza sativa (japonica cultivar-group)
MAAAAAAASLSVSDAAAKLPKPGGQVQRRRDRDRPRVDAAACTRDSRRPTRERCSTTVSLAATATATTATPVRAPVRTRAPMGQRKGADIVVEALERCGVRDVFEYPGGASMEIHQALTRSPVIRNHLLRHEQGEAFAASGYARSSGRPGVCVATSGPGATNLVSALADAHLDSVPLVAITGQAPRRMIGTDAFQETPIVEFTRSITKHNYLILDVDDIPRVINEAFFLASTGRPGPVLVDIPKDIQQQMAVPSWDAPMRLPGYISRLPKPPAANLLDEVIRLVGDAERPVLYVGGGCSASGYELRRFVELTGIPVTTTLMGIGNFPSDDPLSLRMLGMHGTVYANYAVDNADLLLALGVRFDDRVTGKVEAFASRAKIVHVDIDPSELGKNKQPHVSICADVKLALQGMNAMLEEQSAAAARKNLDFSAWRSELEKKKVEFPLGYRTFGEEIPPQYAIQVLDEVTNGEAIVATGVGQHQMWATQHYTYRRPRQWLSSAGLGAMGFGLPAAAGAAVANPGATVVDIDGDGSLLMNIQELAMVRVEDLPVKVMVLNNQHLGMVVQWEDRFYDANRAHTYLGNPAANGGGEVYPDFVTIAGGFGIPAARVTRKGEVRAAVEEMMAAPGPYLLDVVVPHQEHVLPMIPSNGAFKDIIVDGDGRSSY

SEQ ID NO: 5459 - protein, 369 aa, Schedonorus arundinaceus
MVMMVDPPNGMGNHGKHYYTMWQTMFEIDTKYVPIKPIGRGAYGIVCSSINQETNEKVAIKKMNNVFDNRVDALRTLRELKLLRHLRHENVICLKDIMMPVHRRSFKDVYLVSELMDTDLHQIVKSLQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSDSDLEFIDNRKARNYIKSLPYTPGIPLSNMYPQVHPLAIDLLQKMLVFDPSKRISVIEALAHPYMSELYDPAANPPAQVPIDLDIDENIGVETIREMLWQEMLQYHPEAATMVNM

SEQ ID NO: 5460 - protein, 250 aa, Zea mays
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGLRPFGVSFLFAGWDKHHGFQLYMSDPSGNYGGWKAAAVGANSQAAQSMLKQDYKDALTREEAVGLALKVLSKTMDSTSLTAEKLELAEVFLQPDTGEVQYQVCSPEALGKLLANSGLTQPTPEA

SEQ ID NO: 5461 - protein, 210 aa, Glycine max
MKSFDTSPGRCFSSPQHDDNLLHKSISVDAYTYTNTEKEIATKGTGKSRSFTHRIHDHVKMGPNLSEILKGKLSLGARIIQEGGRGSIFKSVFGMQEKEQLLKASQCYLYTTAGPIAGILFVSTEKVAFYSERPITFSSATGELVRAPYKVLIPIGRIKEVNESQNVNKAEQKYIEIVTEDDSEFWFVGFLRYEKALKNLNKAISMANQF

SEQ ID NO: 5462 - protein, 428 aa, Zea mays
ASGRTKHAARTRMAIVREEAVDTSISPRVSALRPSKTMAITDQAMALRQAGVPVIGLAAGEPDFDTPPAIAEAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDKINEKSRLLILCSPSNPTGSVYPKELLEKIADIVKKHPRLLVLSDEIYEHIIYQPAKHTSFASLPGMWERTLTVNGFSKAFAMTGWRLGYLAAPKHFVAACGKIQSQFTSGASSISQKAGVAALNLGYAGGEAVSTMVKAFQERRDYLVKNFKELPGVKISEPQGAFYLFIDFSAYYGSEVEGFGTIKNSESLCIFLLEKAQVALVPGDAFGDDKCIRISYAASLTTLQTAMSKLKEAVALLKPCVAA

SEQ ID NO: 5463 - protein, 205 aa, Triticum aestivum
  unsure (1)..(205): unsure at all Xaa locations
RRSMAVSRSGAAGVAGGGDTTDDADRARLHQLGYKQELKRGLSLMSNFAFSFSIISVMAGVTTTYNGGLRYGGPASMTLGWLVVAFFNGCVALSMAEICSAYPTSGGLYYWSAKLAGEEWAPLASWVTGWFNIVGQWAATKSTDFSLAQLVQVIVLLGTGGANGGGYTAXKYVVLAIHGFFLVLHGLINRLPIRGLACFGKLGAF

SEQ ID NO: 5464 - protein, 221 aa, Enterobacter cloacae
DLLDAEYMAYMLKYDSTHGRFNGTVEVKDGHLVVNGKTIRVTAEKDPANLKWNEIGVDVVAEATGIFLTDETARKHITAGAKKVVLTGPSKDNTPMFVKGANFEKYAGQDIVSNASCTTNCLAPLAKVINDNFGIVEGLMTTVHATTATQKTVDGPSHKDWRGGRGAAQNIIPSSTGAAKAVGVVLPELNGKLTGMAFRVPTPNVSVVDLTVRLEKAASYE

SEQ ID NO: 5465 - protein, 104 aa, Zea mays
  unsure (1)..(104): unsure at all Xaa locations
CKRPPFGRWADQRTPSHGALTDDKXARPRGRPNKLQEQRTVTEKWVEEIRXRFTKSWQGKRTSRPCSESDGXTPKTDDRTDTLGKDNQKGTLTXDTQPAMGGQK

SEQ ID NO: 5466 - protein, 496 aa, Pseudomonas sp. VLB120
MNSSLSAIDGLRLPHQMLIGGQWVSAQSGKTLNVYNPATGDILTEVPDGDVEDVNAAVESAAATLRSDTWRPCLPVLASVFCCAWRISSEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 5467 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLAGLVDALLEGLPPSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDKAFATRGRFQLIEAMIPRGVLSDTLARFVQGQKRLHAAPRE

SEQ ID NO: 5468 - protein, 159 aa, Frankia sp. FE140
ITREEYSRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGKTV

SEQ ID NO: 5469 - protein, 367 aa, Triticum aestivum
  unsure (1)..(367): unsure at all Xaa locations
FGTRPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPXSPXDPNVXVE

SEQ ID NO: 5470 - protein, 505 aa, Azotobacter vinelandii
MPRAAPTPCASCAWATSSIERRGLRCNRANIRTGRATSTSAPRMPNNRSCSPRARPFRPLHRTRHTMSNPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALKGKAPYDASALLKRRCCGGKA

SEQ ID NO: 5471 - protein, 190 aa, Leuconostoc mesenteroides subsp. mesenteroides ATCC 8293
MILIVDNYDSFTYNLAQIVGTKTDLVVLRNDDQKLYATADKADGIIFSPGPGKPEQAGEMENMIRHYANSKPMLGICLGHQAIGEVFGGRVKRAAVIRHGKVSDMLVADTSPLLSTGLVKIMRYHSLILDKKNFPKDFKVVGIAQDDDEIMAMQHKTLPVFGFQFHPESIGTPTGSKMIEKFIALTANVK

SEQ ID NO: 5472 - protein, 153 aa, Mesembryanthemum crystallinum
PPIIFNAGFQVKKKQFFKNFSFILMFGVLGTIISFCLISSGAVLLLKKIGLTQLNLNDYLALGAIFSATDSVCTLQVLNQDETPLLYSIVFGEGVVNDATSIVLFNAVQSLDLSNLSSMTALALLGTFLYLFFTSTILGILVGLLSAYVIKKL

SEQ ID NO: 5473 - protein, 568 aa, Triticum aestivum
  unsure (1)..(568): unsure at all Xaa locations
LRRSSRQEFVALGRVLALHTGAADQDVNDKNIAVQFQYVTWQLQAALTNLPHSCFQISDEVQEEVDLXRGQLKREMEKKGALDLNIFSEIHDILAHHVDHVGSQSEEPHCLPETFPLENLRSDHLELQHVALLISEISGISKSDIKKITSELIEGLENARVDDSAKPTNGDSKTSDEAKDSPDSVKKPDTVAMPEDFRCPISLELMRDPVIVSTGQTYERAFIQRWIDGGNRTCPKTQQKLLNLTLTPNYVLRSLILQWCEEKGIEPPTRSKYEGSSTRGRXDRLAIEALVRNLSCSSLDERKSAAAEIRSLAKKSTDNRMLLAESGAIPALVKLLSSKDPKTQEHAVTSLLNLSIYDQNKELIVVGGAIVPIIQVLRTGSMEARENAAAAIFSLSLIDDNKIMIGSTPGAIEALVELLKSGSSRGRKDAATALFNLCIYQANKVRAVRAGILSPLVQMLQDSSSAGATDEALTILSVLVSHHECKTAIAKAHTIPFLIDLLRSSQARNKENAAAILLALCKKDAQNLACIGRLGAQIPLTELSKTGSDRAKRKATSLLEHLSKLQVL

SEQ ID NO: 5474 - protein, 272 aa, Oryza sativa (japonica cultivar-group)
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVQSKAESRSKSKLSAPKDEEGSGDDEGEEEEDDHDNTLCGTCGTNDGKDEFWICCDNCEKWYHGKCVKITPARAEHIKQYKCPDCTNKRARA

SEQ ID NO: 5475 - protein, 271 aa, Zea mays
MSSLDSGSNGLTGYVTLMSLMEELISLEMKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 5476 - protein, 295 aa, Myxococcus xanthus
MYKQGHGYFWIGGPGEEAFNVSLGLLMKKGQGPDFDYLHAHYRQSGTLLALGEEPIGSLRQMKNTATDPYSGGRNFAGHYSARKYNVAPVSSPIEVQYAIAPGTAMVQKRHGGDGITIVTGGDAGTAEGDFASCLVWSSRPANPLPILIIVTNNKWGISTAAEGQHGEQRISDRGKAFGIRSKTINGNDAVEAYTELREAMAYVRTERKPFLLEANVSRLYGHSSASGANYVSNEVDCLTDFEAKLEKDGVLTREQMDALRNSYTEEMAAAARQVRDEPQPDPESIWKHIYAEDK

SEQ ID NO: 5477 - protein, 354 aa, Catharanthus roseus
MEVQSAEFRKAQVHIWSQSFSFITCASLKCALQLGIADAIENHGKPMALSDLTNTLQINPSKSQYLPRLMRLLVNSGFFSEQQLGDAGGGENVYGLTPSMRLLLKNEPLNLRGIVLPMLDPLQIKAWNSLGNWFKNEDGTAFETAHGKSYWDCVTEDPKDVEIFTETMASDSLLVAKFVITEHKSLFEGLDSIIDVGGSTGTFARAIAESFPSLKCTVLDLPETVANIEPTNNLEFVGGNMFEKIPPAHVVFLKMVLHDWNDEDCVKILKNCRKAIPEKEKGGKVILIETVVQGQMHDSESVKTQIAMDMDMLVSFGTKERTEKEWEILFKEAGFSSYKIFPIVDIRSLIEVYP

SEQ ID NO: 5478 - protein, 314 aa, Zea mays
  unsure (1)..(314): unsure at all Xaa locations
PPVCRCAAPRTRPVLEGHVLDRWRLPLAADTVPLAVSLPLAGLLVFLVPPFASWRCLLPSHPQFLRHAEPDSVPRVQDPSVLPKRCSERVLCGMPCGHQCAASXAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKNLKIHTLYHTAVWQSAARQRRNSPWESVVAKQRGFRHCDRARRANKNRSAGVHTQSISVPWYPSFVCIWA

SEQ ID NO: 5479 - protein, 469 aa, Platyclinia taylorii
VIPYAKMGYWDPDYVIKETDILALFRVSPQPGVDPVEASAAVAGESSTATWTVVWTDLLTACDLYRAKAYKVDAVPSTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAASGEIKGHYMNVTAATMEEMYERAEFAKQLGTVIIMIDLVIGYTAIQTMAIWSRRNDLILHLHRAGNSTYSRQKIHGMNFRVICKWMRMAGVDHIHAGTVVGKLEGDPAMIQGFYNTLLLPYLDVDLPKGIFFKQDWASLRKVTPVASGGIHCGQMHQLLDYLGDDVVLQFGGGTIGHPDGIQAGATANRVALESMVIARNEGIDFVKEGPQILRDAAKTCGPLQTALDLWKDITFNYTSTDTPDFVATPTANV

SEQ ID NO: 5480 - protein, 303 aa, Escherichia coli
MVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 5481 - protein, 394 aa, Coxiella burnetii RSA 493
MNDVLSVRAQQLEPSVTLAVSDLARELLNKGHDVISLSAGEPDFDTPDFIKQSAIKAIQEGFTKYTNVDGTPALKAAIVHKLKRDNHLNYEPSEILVSGGAKQSIYNVLMGTLNAGDEAIIPAPYWVSYPPMVQLAEAKPIIISATIDQNFKLTPGQLSQAITPQSRLLILNSPNNPSGVAYTESELKALADVLMEHPQILILSDEIYEYILWGQNRFVNILNVCPELRDRTIIINGASKAYAMTGWRIGYAAGPKSIIQAMKKIQSQSTSSPNSIAQVAATTALGAQRGDFAYMYEAYKTRHDLVLKALNQMKGVHCIPADGAFYLFPDVSAAIQQLGLEDDIKLGTYLLDKTKVAVVPGSAFGSPGHVRLSCATSTEKLQEALERLASVLDY

SEQ ID NO: 5482 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 5483 - protein, 519 aa, Oryza sativa
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVIPADEIGLGRYVAESTGQQASSRLLSMKSANALLEVPLVGQMLEAGTSMQAILISDMTSSPFDKLPTASNPLPSHLFPSAKSVSTDLSQALTGEKLGGATVVATAVVPDDVEKIKNILVKWSDIDRVSLILTLGGTGFTPRDVTPEATKSVIEKEAPGLTYVMLQESLKIINMPGNPNAVAECMEALLPALKHALKQIKGDKREKHPRHVPHAEAAPVDQWDRSFRAASSGRGCSCEP

SEQ ID NO: 5484 - protein, 594 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCPVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPATLEAYNKARPQTVVPKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKAKGLHAKTGEELTSAIKVALQNKEGPTLIECAIDTDDCTQELVDWGKAVAPPTPVLLPLITRLKRTLFGKNMLHLDYKNYLDIRNT

SEQ ID NO: 5485 - protein, 349 aa, Streptococcus mutans UA159
MIRGLRQIEPYVAGVQPAERKMIKLNTNENAYGASPKVREALANFDVDNLRKYSTLEQADLRAALANNLKVKPEQLMIANGSDDVLSIAFLAFFNNDEPVLFPDLTYGFYKVWADLYRVNYHEIPLAEDFTINTEDYLADNGGIILTNPNAPTGIYKPLNEIEKLLKANQDTVVIIDEAYISFGGQSALSLLNKYNNLVITRTFSKDAALAGLRVGYAIANEPLIAVMNAVKHSINPYSVDLLAERLATAAVEDWSYYQENAKKIQKTRAWFSEQLVKQGFDVLPSQANFVLTKPHDLATAKLFEELEARKIYVRYFPKVERIKDYLRISMGTQEEMEEVVKAIEEIRG

SEQ ID NO: 5486 - protein, 684 aa, Glycine max
MVAVCKQHEICLIWVQKNTKEGQEEVAEDWLEKFSPWEVVRHDILYPIKFFGHVEVNPDGSRKWVGGEVVQALAYDVPIPGYQTKNTISLRLWEAKASAEDFNLFLFNDGQHDAASVLHSRAQQICAVLYPGDTTEGGKLLRLKQQFFLCSASLQDIISRFKERRQGPWNWSEFPTKVAVQLNDTHPTLAIPELMRLLMDDEGLGWDEAWDVTSKTIAYTNHTVLPEALEKWSQPVMWKLLPRHMEIIQEIDKRFTAMINTTRLDLENELSAMRILDDNPQKPVVRMANLCVVSSHAVNGVAQLHSDILKSELFANYVSIWPTKFQNKTNGITPRRWLQFCNPELGGIITKWLKTDKWVTNLDLLTGLRQFADNEDLQAEWLSAKMASKQRLARYVLQVTGESIDPDTLFDIQVKRIHEYKRQLLNILGVIYRYKKLKEMSLEERKNTTPRTVMIGGKAFATYTNAIRIVRLVNDVGAVVNSDPEVNGYLKVVFVPNYNVSVAEVLIPGSELSQHISTAGMEASGTSNMKFALNGCLIIGTLDGANVEIREEIGEDNFFLFGATAEDVPRLRKERENGLFKPDPRFEEAKKFIRSGVFGSYDYNPLLESLEGNSGYGRGDYFLVGHDFPSYMDTQAKVDEAYRDRKRWLKMSILSTAGSGKFSSDRTIAQYAKEIWNIEECRVP

SEQ ID NO: 5487 - protein, 464 aa, Glycine max
MANTLYNGATCRIPLRDQSLAFSRHVSRSLSFLPITRAAKQPNAIAVKASSHSDFDVDLSLSPRVNAVKPSKTVAISDHATALVQAGVPVIRLAAGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVQSFREIDGIKISEPQGAFYLFLDLSFYYGREAEGFGKIVDSESLCQYLLEVGQVALVPGSAFGDDTCIRISYAESLTTLQAAVERIKKALVPLSSAALV

SEQ ID NO: 5488 - protein, 605 aa, Geobacter metallireducens
MDQHKGDASLGGIVKALGLVFGDIGTSPIYTLTVIFTLTQPTRENVFGILSLVFWTMTILVTMEYAWLAMSLGRKGQGGEIVLREIIMKLVKTGRLVAFAGFLSFVGVSLLLGDGVITPAISILSAVEGLLLIPGLEGLSTGTLVAIAAAIAIGLFSVQFKGTDRVAGAFGPIMAVWFSTLAVTGVVSALSMPEIVEAINPWHAFTFFRENGLAGYFVLSEVILCSTGGEALYADMGHLGRRPIVKSWYFVFMALYLNYLGQGVFAITHPEAKNLLFGMVRDQMPTLYIPFLILTIMATIIASQSIISGVFSIVYQGITTRLLPLMRVDYTSREIKSQIYLGAVNWSLMVAVILVMLLFRKSENLAAAYGMAVTGSMTITGIMMIIVFAHTTKKWRALVALVITLIDAAYLLSTFSKIPHGAYWSLILASIPFVTIIIWTRGQRSLYHALKPLDLETFLISYEQIYAKGPIRGTGLFFTRDTDVVPPYVVHCIIRSNIIYERNVFISLVITDEPLGVETELIKGIGPGLDAFRIEAGYMEVVDIEALLKANGIQEKVIFYGVEDISTRNPLWRVFSVFKKLTPNFVQFHKLPASRLQGVVTRVEM

SEQ ID NO: 5489 - protein, 1188 aa, Pisum sativum
MKPLYSTNTLLLLLALFLLHLGPSHSSSSSSSSTSSSQLLYFKQSLPNPSLLHDWLPYKNPCSFTGITCNQTTVTSIDLTSIPLNTNLTVVATYLLTLDHLQVLTLKSSNITSSPISLSHTKCTSSLTTIDLSQNTISSSFSDLAFLSSCSGLKSLNLSNNQLDFDSPKWTLSSSLRLLDVSDNKISGPGFFPWILNHELEFLSLRGNKVTGETDFSGYTTLRYLDISSNNFTVSIPSFGDCSSLQHLDISANKYFGDITRTLSPCKNLLHLNLSGNQFTGPVPSLPSGSLQFLYLAENHFAGKIPARLADLCSTLVELDLSSNNLTGPVPREFGACTSVTSFDISSNKFAGELPMEVLTEMNSLKELTVAFNEFAGPLPESLSKLTGLESLDLSSNNFSGTIPRWLCGEESGNNLKGLYLQNNVFTGFIPPTLSNCSNLVALDLSFNYLTGTIPPSLGSLSKLRDLIMWLNQLHGEIPQELSNMESLENLILDFNELSGTIPSGLVNCTKLNWISLSNNRLTGEIPSWIGKLSNLAILKLSNNSFSGRIPPELGDCPSLIWLDLNTNFLTGPIPPELGKQSGKVVVNFISGKTYVYIKNDGSKECHGAGSLLEFAGINQEQLRRISTRNPCNFTRVYGGKLQPTFTLNGSMIFLDVSHNMLSGTIPKEIGEMTYLYVLHLSHNNLSGSIPQELGKMKNLNILDLSYNKLQDQIPQTLTRLSLLTEIDFSNNCLSGMIPESGQFDTFPVGKFLNNSGLCGVPLPPCGSDSGGGAGSQHRSHRRQASLAGSVAMGLLFSLFCVFGLIIIAIETRKRRKKKEAAIDGYIDNSHSGNANNSGWKLTSAREALSINLATFEKPLRKLTFADLLAATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKMNWSVRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDVFDKELMKEDPNLEIELLQHLKVACACLDDRPWRRPTMIQVMAKFKEIQAGSGMDSQSTIATEDEGFNAIEMVEMSIKEVPELIKH

SEQ ID NO: 5490 - protein, 429 aa, Synechocystis sp. WH 8501
MKKVLAIILGGGAGTRLYPLTKLRAKPAVPLAGKYRLIDIPISNCINAEILKIYVLTQFNSASLNRHLTRTYNFTGFSDGFVEVLAAQQTAENPSWFQGTADAVRQYLWLFDEWDVDQYLILSGDHLYRMDYSDFVRRHQETGADITLSVVPIDERRASSFGLMKIDDSGRVVDFSEKPKGDALKQMQVDTSILGLNPEQAKESPYIASMGIYVFNKKALTDLLRNNPEQTDFGKEIIPGSAKDYNLQAYLFKGYWEDIGTIEAFYEANLALNRQPLPRFSFYNEKAPIYTRARNLPPTKVLNCNITESMISEGCMIKDCRINNSVLGIRSRIESDCVVEDSLLMGADFYESLDTRQSLLDQGKIPVGIGKGSTIRRAIVDKNARIGTNVNIVNKENIEESNREDDGFYIRNGIVVVIKNAVIPDGTVI

SEQ ID NO: 5491 - protein, 403 aa, Corynebacterium glutamicum ATCC 13032
MAQQRSVDDYLSILIDSVAPLPPVKTPILGAHPLSHLAEDVVATIPIPKFTNSAVDGYAILKEDIHGSGPWTFLVGGDTPAGSAPASINNGKAIRVMTGGPVPSTNKDMIVVPVELTNAPVDHSLPTEITINELPGERNNIRHAGEHLKEGEIAVAAGTAFDAGTVSTVISVGHDTVKAHPCPRVAVITTGDELNQGNPWGIPNSNGPMLVAELKRVGIKDPQHFHSDDSETALRETLDKAAEVADVIITVGGISAGAFDVVKAVGTKTGGFEFFPIAMKPGKPQGHGQWGDAKVVCLPGNPVAAWVSFRLFVVPVIERLGGGKRLASISELPVVALRSNRALKAREGAVLAIPVAIDWEKRMANSQAHRSHMVGALAGSGGIALVTSSIAEDGLVDVVLGRM

SEQ ID NO: 5492 - protein, 573 aa, Clostridium thermocellum ATCC 27405
MAKSVDDMVINKRVNIKRYKEIISVFAKHGFGLLFDQLGIFDYLKMGKKFSSDEGEDDSAKLSMGERIRLSCEELGPTFVKMGQILSTRPDVIPSDIIEELKKLQDSVHPFSFDEVRTVIESEFEDKIENIFMEFSEEPIAAASISQVHCARLKSGEKVAVKVQRPGIERNIALDLNILKDLVHFIENHTKYGKIYDLVGIVVDFENTIKNELDFTKEGENAETFRKNFAKDGIARVPEIKWTYTTRRVLTMEYVEGIQIDDLEGLEKAGIDKVELARNLATSICNQILTDGFYHADPHPGNIRVLADGTIVFLDLGMVGIINESRKKMISNFFIGVSTKNSKIVARSIVDLGEMSERRNLKRFEKDIDKMIDKYIAMPWSEIKVVDLFYEVFNIAFVNEIKIPREFAMLAKTLGTAQGVLEKLAPDLNTIEIAKPIAKKLMYRSFSIKNVTDSIKKNALNYRDAMDLLNEFPSIVLGILEKFEDRDYTLQLGIKDIDKIMKRLDRNFNRMSLSVVLLAVSIIITGVIIGSSQSASPGSEMYFVNVTALRIGLGIVVAIILGLVISMFRSNHF

SEQ ID NO: 5493 - protein, 469 aa, Pseudomonas syringae pv. syringae B728a
MSETTSPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPGWVSAAAFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDTAAHILNFVVLTAALSVYNSGTYCNSRMLVGMAEQGDAPRALAQVDKRGVPVKAIFASAAVTLVAVLLNYFVPQQALELLMSLVVATLVINWAMISYSHLKFRQHMNRTAQVPLFKALWYPYGNYVCLAFVVFILGIMLMIPGIQISVYAIPVWLAVMWVCYRAKNRRSVVVPAESGK

SEQ ID NO: 5494 - protein, 40 aa, Brassica napus
  unsure (1)..(40): unsure at all Xaa locations
PISXFRXPKFLCLASSSPALSSKEVESLKKPFTPPKEVHV

SEQ ID NO: 5495 - protein, 465 aa, Lycopersicon esculentum
MGSGAIDDSSKFDDDGRPKRTGTVLTTSAHIITAVIGSGVLSLAWATAQLGWIAGPVALIAFSAITWFASILLADCYRAPDGSRSYTYMDAVRAHLGGRKVQLCGLAQYSNLFGVTIGYAITTSISMVAIKRSNCFHRKGHDAGCHESNNPFIIIFGVMQILLSQIPNFHKLSFLSIIAAAMSFAYSFIGLGLSIAKIAKDGVSANTSLTGTIVGKDVSSRDKMWNTFSALGDIAFAYAFSIVLIEIQDTLKSHPPENKSMKKATFTGISVSTIFYLLCGLLGYAAFGNKAPGNFLTGFGFYEPFWLIDFANVCIVIHLVGAYQVFCQPIFGFVEGWSRQKWPESKFITKEYMINLSHLGLFNFNFYRLVWRTLYVVFTTILAMLFPFFNDFVGFIGAASFWPLTVYFPIQMYIAQAKIPKYSFTWIWLNILSFVCLIISLLAAAGSVRGLIKSLQEFEPFQSRS

SEQ ID NO: 5496 - protein, 385 aa, Zea mays
  unsure (1)..(385): unsure at all Xaa locations
PRVRTSLHTLHLPLPSSNQAYNIINMGVIEKLSRKAGVIVGDDVLRLFEYAQEKQFAIPAINVTSSSTVVAALEAARDQKSPIALQVSQGGAAFFAGKGVSNDGQAASIXVPSPLLTTSAPLPPPTAFPSSSTPITAPRSSSPGSTAXWMRMSATSSSTASPXFSSHMIDLSEEPVDWNISTTAAYLKRAAPMKQWLEMEIGITGGEEDGVNNEDVDNNSLYTQPXDILAIHNALSAISPYFSIAAGFGNVHGVYKPGNVRLHPELLKKHQAYVKEQTKSQKEKPVFFVFHGGSGSSKEEYKEAISYGVVKVNVDTDMQYAYLSGVRDYVLNKKDYLMSTVGNPDGEDKPNKKFFDPRVWVREGEKTMSKRTQVALEDFNCTNQL

SEQ ID NO: 5497 - protein, 221 aa, Escherichia sp. Souza-57
DLLDAEYMAYMLKYDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARIEKKATYK

SEQ ID NO: 5498 - protein, 213 aa, Vibrio cholerae
MSENNQCVIVGIAGASASGKSLIASTIYNELRAKVGDHQIGVITEDCYYKDQSHLSMEERVKTNYDHPSALDHDLLCQHLQMLARGEAVEVPEYSYTEHTRTEQTTTMTPKKVIILEGILLLTDPRLRDLMHATVFMDTPLDICLLRRVKRDVQERGRTMESVLKQYQETVRPMFMQFIEPSKQYADIIVPRGGKNRIAIDVLKAHIAKLLKS

SEQ ID NO: 5499 - protein, 240 aa, Papaver rhoeas
EALEREGVTNVFAYPGGASMEIHQALTRSSSIRNVLPRHEQGGIFSAEGYARASGLPGVCIATSGPGATNLVSGLADALLDSIPIVAVTGQVPRRMIGTDAFQETPIVEVTRSITKHNYLVLDVEDIPRVVKEAFFLATSGRPGPVLIDVPKDVQQQLVVPKWDTPMKLPGYMSRAPKSPEHNLLEQVVRLISESKKPVLYVGGGCINYSEELRRFVDLTGIPVASTLMGLGAHSCTDVL

SEQ ID NO: 5500 - protein, 261 aa, Triticum aestivum
  unsure (1)..(261): unsure at all Xaa locations
MWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKXGNLKFPRKNYFLLWMVENMNGDRAKFHSSGHEERQSVCPSSGGTSSSQHHRRTPTARAETSSSARDRNAAANTPNTASVSLQKLMVCFVQLTAKFPLVIMFLLIVXYAVPASAAVXLLYVLVTFLFALPSFLILYFAYPTLDWLVREIFT

SEQ ID NO: 5501 - protein, 496 aa, Staphylococcus epidermidis ATCC 12228
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNAGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGVGRELGKEGLEEYLVSKHILTNTNPEPVDWFSK

SEQ ID NO: 5502 - protein, 336 aa, Staphylococcus aureus
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKPDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 5503 - protein, 202 aa, Triticum aestivum
  unsure (1)..(202): unsure at all Xaa locations
RMECSIRAIRTFPKSGIRVMXIPDMLFDSXALRAFSDLFVELFERNDITVVAVVEARGFSCGPPVALATGAKFVPIRTLRKLPGEVISEVYSVEYGADNIDMLVGPVQPNDRVLRVDDVDATGGTLCAAGNLIERVGAKVAECAGVIDLPELTDRDKLGDMAVISVVQADESVGTKLCLLSCSNDVYLVDLYWKQQRYPLQS

SEQ ID NO: 5504 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELEHTQPGAWGRIQLTDAIAELAKKQSVDAMLMTGDSYDCGKKMGYMQAFVKYGLRNLKEGAKFRKGIEKLLSE

SEQ ID NO: 5505 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPRKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 5506 - protein, 514 aa, Zea mays
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAALLTLGALFVTDTPNSLIERGRLDEGKAVLKRIRGTDNVEPEFNEIVEASRVAQEVKHPFRNLLQRRNRPQLVIAVLLQIFQQFTGINAIMFYAPVLFNTLGFKSDASLYSAVITGAVNVLSTLVSVYSVDRVGRRMLLLEAGVQMFLSQVAIAVVLGIKVTDHSDNLGHGWAIMVVVMVCTFVSSFAWSWGPLGWLIPSETFPLETRSAGQSVTVCVNLLFTFVIAQAFLSMLCHLKYAIFVFFSAWVLVMSLFVLFFLPETKNVPIEEMTERVWKQHWFWKRYMDDDNHHIVNGKLTGASG

SEQ ID NO: 5507 - protein, 473 aa, Oryza sativa; identical to SEQ ID NO: 3586

SEQ ID NO: 5508 - protein, 484 aa, Capsicum annuum
SSAFNSPFCTTNSGAPVWNNNSSLTVGARGPVLLEDYHLVEKLANFDRERIAERVVHARGASAKGFFEVTHDITHLTCADFLRAPGVQTPVIVRFSTVIHERGSPETLRDPRGFAVKFYTREGNFDLVGNNFPVFFIRDGMKFPDMVHSLKPNPKSHIQENWRVLDFFSHHPESLHMFTFLFDDIGIPQDYRHMDGSGVHTFTLINKAGKSTYVKFHWRPTCGVKSLLEEEAIRVGGANHSHATQDLYDSIAAGNYPEWKLFIQTMDPAHEDRFDFDPLDVTKTWPEDIFPLQPLGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAENYPIPTTVCSGKREKCIIQKENNFQQPGERYRSFSADRQERFIRRWVEALSDPRITYEIRSIWISYWSQADKSLGQKLASRLNVRPSI

SEQ ID NO: 5509 - protein, 540 aa, Corynebacterium efficiens YS-314
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 5510 - protein, 397 aa, Oryza sativa
MGPTSRNHKSSQKEVAKERPSSSTAGEGEPQETVLKLPSIPTLPARMAKLVPLEGLGCEAAVGSLTPSREREYKVTNKHTEGRRPVYAIVFNFLDVRYYDIFATACGPRLSTYRCLMNGKFALLQSYLDDDMNESFFTVSWACDIDGNPLLVAAGSTGIIRVINCATEKIYKDESIKLWNVQTGILILVFGGVGGHRHEVLGVDFHTSDIYRFLSCGMDNTVRIWSMKEFWEYVEKSYSWTDATSKFPTKFVQFPVLCAEIHSNYVDCTKWLGDFVLSKSVENEILLWESITKEENPGEGHIDVLQKYPVPECNIWFMKFSCDFHHNQLAIAQSLPAQRMATYGVGMKWITQPPQSQARNKSEARIILIEINKAELAICSWYTLLYYFALAFIKTAI

SEQ ID NO: 5511 - protein, 352 aa, Xanthomonas axonopodis pv. citri str. 306
MSTAHAYAAQAADQPLAPFVFERRAPGPNDVQIDIAYCGVCHSDLHTARNEWHNTLYPSVPGHEIVGRVTAVGNAVTGFKVGDLAGVGCMVDSCRSCASCQEGEEQYCEAGFTGTYNGPMFGGGENTYGGYSDHIVVDQKYVLRITHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAIVLVGVPEQSHPSPAVFNLVMKRRTLAGSLIGGIRQTQEMLDFCAKHNIVSDIETIRADQINEAYERMLKSDVKYRFVIDMATLDQAA

SEQ ID NO: 5512 - protein, 207 aa, Glycine max
  unsure (1)..(207): unsure at all Xaa locations
MNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTXWAVELEKQSNAKTLPHAKNSMTEEEIRLLRDGVD

SEQ ID NO: 5513 - protein, 412 aa, Glycine max
MASWWCSSPSATLTVSTTTTRHFSLLSHTSQFRIQTLTFPPSSFTRFTTAPPSLRFRVPCSNKTAFETELPEDGVDCVGTGQDVECLVNTEEKQSEPSSSSSSSSSSSSMLCLAEALWEGAVLVSPFFFWGTAMVAMKEVLPKCGPFFVSAFRLIPAGFLLVAFAASRGRTLPSGFNAWLSITLFALVDAACFQGFLAEGLQRTSAGLGSVIIDSQPLTVAVLAALLFGESIGVVGAAGLVLGVIGLVLLELPALSFDESNFSLWGSGEWWMLLAAQSMAIGTVMVRWVSKYSDPVMATGWHMVIGGLPLVLFAVLNNDPAVSLSLKEYSSTDILALLYTSIFGSAVSYGVFFYSATKGSLTKLSSLTFLTPMFASIFGFLYLGETFSPVQLVGALVTVAGIYMVNFRSTSE

SEQ ID NO: 5514 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 5515 - protein, 506 aa, Oryza sativa
MAARSFSSASTTTILLRSGRWRRTMRAAAFPFRVSCSAAAAAAAGGTVVIGLAADSGCGKTTFVRRLTSVLGAGTAAAAAPPWGGNPGSNTLLGDAATVICLDDYHSLDRAGRKERGVTALDPRANDFDLMYRQLKAIKEGRAVAKPIYNHATGLLDPPELITPPKILVVEGLHPMYDERVRGLLDFSIYLDISSDIKFAWKIQRDMAERGHSLESIKASIEARKPDFDAYIDPQKQYADAVIEVLPTRLIAAADDDGDEGKVLRVKLIMKEGVEHFAPAYLFDEGSTISWIPCGRKLSCSYPGIKFSYFPDTYFGHEVSVLEMDGKFDKLDELIYVESHLSNLSTKYYGEVTQQMLKHADFPGSNNGTGLFQTIVGLKIRDLYEQSGGGRERRQWRWGGWVLDWCRILGWLMGFVRCGAELERSDIYSGADGSGLAAAAARGEMDRDDEWLPRALAAFGGGGSGVWELVDAALACAAHDRPDELRARRDGFVERLYAAAAGGCSN

SEQ ID NO: 5516 - protein, 205 aa, Olea europaea
SGGVTSMDDFLKKFFPAIYERKLHAKENNYCKYDDQLLQLFTSSLYLAALVASFGASKACNVLGRKPTIGLASILFILGAIASGIAPNKALLIIGRILFGFGVGFGNESVPLFLSEVAPMQHRGAVNILFQLFVTIGILIANLVNYAVSSIHPNGWRIALGLAGVPAIFLFIGSLIITETPSSLIERGKEFEGKEVLRKIRGVDD

SEQ ID NO: 5517 - protein, 245 aa, Tsuga mertensiana
YTYNLRNKGPEDVIVRVIYCGICHSDLIQMRNEMGTSHYPMVPGHEVVGIVTELGSEVKKFKVGEHVGVGCIVGSCRKRGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKITKAFGLHVTVISSSDKKKEEALEVLHADAYLVSKDAEKMQEAAESLDYILDTIPVAHPLEPYLSLLKTNG

SEQ ID NO: 5518 - protein, 244 aa, Zea mays
  unsure (1)..(244): unsure at all Xaa locations
MDLLDARHRHTPDLSSSQDAASNMGLPLAGAAYQPYVSELLSFSIERLHKEPELLRVDAERVRRQMQEVAVENYAAFIAASEALSFVRAQLESFDGHLEAMIEEIPNLTSGCTEFVESAQQILEERKLNQTLLANHTTLLDLLEIPQLMDTCIRNGNYDEALDLEAFVSKIWKLHPDLPVVQGLATEVKKTVQSLVSQLLQKLRSNIQLPECLRIVAHLRRIGVFSESELRLQFLRCRXAWLSG

SEQ ID NO: 5519 - protein, 492 aa, Triticum aestivum
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSSKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRVDPTRHAEKDPMPPRVLSGCREKCIIDKENNFKQAGERYRSFDPARQDRFLQRWVDALTDARVTHEIQSIWVSYWSQCDASLGQKLASRLKIKPNM

SEQ ID NO: 5520 - protein, 347 aa, Pichia stipitis
MSIPTTQKAVIFETNGGPLLYKDIPVPKPKPNELLINVKYGVCHTDLHAWKGDWPLDTKLPLVGGHEGAGVVVALGENVTGWEIGDYAGIKWINGSCLQCEYCVTAHESNCPDADLSGYTHDGSFQQYATADAIQAARIPKGTDLALIAPILCAGITVYKALKTAQLQAGQWVAVSGAAGGLGSLAIQYAKAMGYRVVGIDGGADKGEFAKSLGAEVFVDFLSSKDVVADVLKATNGGAHGVINVSVSERAMQQSVDYVRPTGTVVLVGLPAGAKVSASVFSSVVRTIQIKGSYVGNRADSAEAIDFFTRGLIKCPIKIVGLSELASVYELMEQGKILGRYVVDTSK

SEQ ID NO: 5521 - protein, 477 aa, Xylella fastidiosa 9a5c
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIDLPAALVNAPLDGTLHATGAIANLPAATIVLLLTWLCYFGIRKSSKINIAMVALKSGLILLIIGVGWKYVNPDYWQPFIPPNQGPGKYGWDGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFAAVCAGVLILRCTRPDLPRPFRMPAAWLFCSAGVLSCITLLSAMTRHNWMLMSVWTVLGFALYFGYGYRHSKLHREST

SEQ ID NO: 5522 - protein, 545 aa, Oryza sativa
MDSARSWFQKFQPRDKSKSPAVAASHGKDPGKPPIDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAFIVKLYYSFQDEEYLYLIMEYLPGGDMMTLLMRKDTLTEDEARFYIAETVLAIESIHKHSYIHRYQISVPKFWDIKPDNLLLDRSGHLKLSDFGLCKPLDSSNFPNLNEPDYTSTKGTKPLPDSSSRLSSSALKRTQQEQLSHWQKNRRMLAYSTVGTPDYIAPEVLLKKGYGMECDWLVSYLIVNWRSHLKFPEEAKLSPEAKDLISKLLCNVEQRLGTKGAHEIKAHPWFRGLPWERLYQMKAAFIPEVNSELDTQNFEKFEETGAQIQSSSKSGPWRKMLPSKDANFVGYTYKNFEIVNDDEVAGIAELKKKSSKSKRPTIKTLFGIEHYYYLLVPYTPCTVFHDMFNLLLSLKQRAWMKMSLFKEVS

SEQ ID NO: 5523 - protein, 488 aa, Escherichia coli
MKKVNHWINGKNVAGNDYFQTTNPATGEVLADVASGGEAEINQAVAAAKEAFPKWANLPMKERARLMRRLGDLIDQNVPEIAAMETADTGLPIHQTKNVLIPRASHNFEFFAEVCQQMNGKTYPVVDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVGALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 5524 - protein, 485 aa, Kluyveromyces lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVALINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 5525 - protein, 217 aa, Cryptomeria japonica
MVRGKVNLQRIQNPVNRRVTFSKRKAGLLKKAGELSVLCEAEICSIIFSPTGKLFEFASHSMNRIIGKYKKNCASIGHHIQLQEHLETLRMELENLRIETTHLEKTCKHMNGEDLDFLNFKELQKLEKKMSLSARKIHLRKDKILVENVGSLKSKEKLLELENAEMDKKIGRSHKACHLNINMMDEVNSKLETEASTRQDCLKLTLISRNFHDDNFC

SEQ ID NO: 5526 - protein, 372 aa, SYNECHOCOCCUS SP. WH 8102
MSDTIQPFTPGGAPAARAAVEQLKAYSAPLEGRRHMLRLDFNENTIGPSPLVAQALRNFSTEEIAVYPEYDGLREALLQNLVETGCRPGLKPAQVGLFNGVDAAIHAVLQAYGDAGETLLTTAPTFGYYSPCAGMQGMTIKAISYEGETFDFPLAAIQEALAARTPRLLLICNPNNPTGTRLPADQVIALAASAPGTLVVVDELYEAFTGDSVLPSADFTATPNLLVFRSLAKTAGLAGLRIGFAIGHADVVDRVSRVTGPYDVNSVAVAAAFAALADQSYVDAYVAEVLRARDWTVEALLQADVRHHCDGGNYLLIWPRRSVEEIDAALRSEGILIRSMAGKPLIDGCFRVSIGTTSQMQRFMEAYLSIDP

SEQ ID NO: 5527 - protein, 426 aa, Staphylococcus xylosus
REVIPERRMHATGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHCHIRQCYIAD

SEQ ID NO: 5528 - protein, 128 aa, Salmonella enterica
FGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 5529 - protein, 392 aa, Oryza sativa (japonica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 5530 - protein, 243 aa, Synechocystis sp. WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 5531 - protein, 202 aa, Glycine max
  unsure (1)..(202): unsure at all Xaa locations
MLIIISFLPQIKQISTVNPSLFPSILTSSLSRCTDLRGVCVLGFLPFLSLSALHFCVFFSIGVSKMPMFQPCRKDLVAGYEGGGDGQILDLDTAVKDGVLGGVEGGVLGGGVGEKVDLGKMIEELELCEVPSVFICPISLEPMQDPVTLCTGQTYERSNILKWFNLRHFTCPTTMQELWDDSVTPYTTLSALIHXWISQKYL

SEQ ID NO: 5532 - protein, 314 aa, Rhizobium tropici
VMFDGSSIAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKSGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 5533 - protein, 207 aa, Arabidopsis thaliana
MNAIHEVFTVSKAQTLIALCGTVPGYWFTVAFIDILGRFFIQLMGFIFMTIFMFALAIPYDHWRHRENRIGFLIMYSLTMFFANFGPNATTFVVPAEIFPARLRSTCHGISAASGKAGAIVGAFGFLYAAQSSDSEKTDAGYPPGIGVRNSLLMLACVNFLGIVFTLLVPESKGKSLEEISREDEEQSGGDTVVEMTVANSGRKVPV

SEQ ID NO: 5534 - protein, 421 aa, Physcomitrella patens
MGRKPCCEKVGLRRGPWTSEEDQKLVSHITNNGLSCWRAIPKLAGLLRCGKSCRLRWTNYLRPDLKRGIFSEAEENLILDLHATLGNRWSRIAAQLPGRTDNEIKNYWNTRLKKRLRSQGLDPNTHLPLEDSKLDDTEDDTDDEGGDSSDVTMSDASKSEKRSKKKSKPKETVKVRQPKGPKPAPQLKMCQSDEGPVLLKVPKAPKSPISVNPGPGCNYDDDSEHSSSSTVTTKSHEDHRDSSDFIKALTSVSSFPEAELWSCIKPITNSFSSTALLSEWDSYRAFDSSLFPSSYPQLNSGLPKLEDVNSKSSAVASPVQGMLPAYNPMGMEMQTRMQFSSQLTHEIGQNYGGIFQETCYPQPDMGMSWSMHAELSHCGTESLFATPNPANAPSNFEEVPQPSPCTTSQELQRLAALLDLI

SEQ ID NO: 5535 - protein, 466 aa, Turbinaria ornata
DAKMGYWDADYKVKETDILALFRITPQPGVDPVEAAAAVAGESSTATWTVVWTDLLTACDIYRAKAYRVDPVPGTNDQYFSYIAYECDLFEEGSLANLTASIIGNVFGFKAVKALRLEDMRIPYAYLKTFQGPATGVIVERERLDKFGRPLLGATVKPKLGLSGKNYGRVVYEGLTGGLDFLKDDENINSQPFMRWKERSIYCMEGVNRSAAATGEVKGSYLNVTAATIENMYERAEYSHAIGSVICMIDLVVGYTAIQTMAIWARKAEMILHLHRAGNSTYARQKNHGINFRVICKWMRMSGVDHIHAGTVVGKLEGDPLMVRGYYNTLLLTELKINLAEGIFFDMDWASLRKCVPVASGGIHCGQMHQLLYYLGDDVVLQFGGGTIGHPDGIQAGATANRVALEAMVLARNEGRDYVGEGPEILCTAASTCGPLKAALDHWKDITFEYTSTDTPDFVEVATESP

SEQ ID NO: 5536 - protein, 376 aa, Nicotiana benthamiana
MADANMGGGGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLANVFPHVNPLAIDLVDKMLTLDPTRRITVEEALDHPYLAKLHDAGDEPICPVPSSFDFEQQGIGEEQIKDMIYQEALSLNPEYA

SEQ ID NO: 5537 - protein, 372 aa, Nicotiana plumbaginifolia
MRCVVLENMGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWRDPAIQETILRGNELQVPDCAHYFMENLQRFSDVNYVPSKEDVLFARIRTTGVVEIQFSPVGENKKSGEVYRLFDVGGQRNERRKWIHLFEDERKNRMMETKELFEWVLKQPCFEKTSFMLFLNKFDIFEQKALKVPLNVCEWFKDYQPVSTGKQEIEHAYEFVKKKFEESYFQCTAPDRVDRVFKIYRTTALDQKLVKKTFKLVDETLRRRNLFEAGLL

SEQ ID NO: 5538 - protein, 450 aa, Novosphingobium aromaticivorans
MPSISDLRGTNMIRKMIGGLAGTGASLFAATAAHAQEAAAATVDKGDTAWMLTSTILVLMMILPGLALFYGGLTRTKNMLSTMTQIGAVACFAMLLWVMYGYGLAFGPEGNAFISWGKWFLAGVTPASQAATFTAGVEIPEYVFICFQMTFAAITIALVLGSVVERMKFSAVMAFAAVWLTIVYFPIAHMVWAAGGLFFDMGALDFAGGTVVHINAGVSALVACLILGKRIGFQKDIMAPHSLTMTGIGTGLLWVGWFGFNAGSALEANGSAALAMINTFVATASAGLFWMLAERLSGHKGSALGFCSGIIAGLVAVTPAAGNSGPFGAIVLGGLASVVCFYMVTVVKPKLGYDDALDAFGIHGVGGMIGAVGTAVVYAPSLGGPGAADYDMGAKLVVQIMAVGTTIVWAAIGTVVAMYVAKALTGLRVTEEVEREGLDLGEHGERAYNY

SEQ ID NO: 5539 - protein, 170 aa, Zea mays; identical to SEQ ID NO: 2818

SEQ ID NO: 5540 - protein, 745 aa, Glycine max
GLFKQRITKDGQEEVADDWLEMGNRVQIIRNDVSYPVKFYGKVVSGSDGKKHWIGGEDIKAVAHDVPIPGYKTKTTINLRLWSTKAASEEFDLSAFNAGRHTEASEALANAEKICYILYPGDESIEGKILRLKQQYTLCSASLQDIIARFERRSGTNVNWEEFPEKVAVQMNDTHPTLCIPELMRILIDVKGLSWKDAWNITQRTVAYTNHTVLPEALEKWSLDLMQKLLPRHIEIIEMIDEELIRTIIAEYGTENSDLLEKKLKEMRILENVELPAEFADIVVKSKEAIDIPSEELQSSEQAEVEERKDDEVEAVAKKNGTDESSIEDEKEELPEPVPEPPKLVRMANLCVVGGHAVNGVAEIHSEIVKDDVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLMNIFGIVYRYKKMKEMSAAEREANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPSYIECQEKVDEAYRDQTKWTRMSILNTAGSYKFSSDRTIHEYAREIWNIEPVQLP

SEQ ID NO: 5541 - protein, 765 aa, Synechococcus sp. PCC 7942
MSTYQQQHVKVVCYLSAEFLMGRHLENCLINLHLHDRVQQVLDELGLDFEQLLEKEEEPGLGNGGLGRLAACFLDSMATLDIPAVGYGIRYEFGIFHQELHNGWQIEIPDNWLRFGNPWELERREQAVEIKLGGHTEAYHDARGRYCVSWIPDRVIRAIPYDTPVPGYDTNNVSMLRLWKAEGTTELNLEAFNSGNYDDAVADKMSSETISKVLYPNDNTPQGRELRLEQQYFFVSASLQDIIRRHLMNHGHLERLHEAIAVQLNDTHPSVAVPELMRLLIDEHHLTWDNAWTITQRTFAYTNHTLLPEALERWPVGMFQRTLPRLMEIIYEINWRFLANVRAWYPGDDTRARRLSLIEEGAEPQVRMAHLACVGSHAINGVAALHTQLLKQETLRDFYELWPEKFFNMTNGVTPRRWLLQSNPRLANLISDRIGNDWIHDLRQLRRLEDSVNDREFLQRWAEVKHQNKVDLSRYIYQQTRIEVDPHSLFDVQVKRIHEYKRQLLAVMHIVTLYNWLKHNPQLNLVPRTFIFAGKAAPGYYRAKQIVKLINAVGSIINHDPDVQGRLKVVFLPNFNVSLGQRIYPAADLSEQISTAGKEASGTGNMKFTMNGALTIGTYDGANIEIREEVGPENFFLFGLRAEDIARRQSRGYRPVEFWSSNAELRAVLDRFSSGHFTPDQPNLFQDLVSDLLQRDEYMLMADYQSYIDCQREAAAAYRDSDRWWRMSLLNTARSGKFSSDRTIADYSEQIWEVKPVPVSLSTSF

SEQ ID NO: 5542 - protein, 481 aa, Escherichia coli
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 5543 - protein, 525 aa, Triticum aestivum; identical to SEQ ID NO: 1693

SEQ ID NO: 5544 - protein, 832 aa, Burkholderia fungorum
MRFAHAALLISPEASMTAVDLEFDQLNSTVDALRRSISNRMMYGVGKDAVTAHPHDWLHAAALAVRDRLVARWMKTTRLQYEQDVKRVYYLSMEFLIGRTFTNALLALGIHDQMKEALASLGVDMQMLTDIEPDAALGNGGLGRLAACFLDSMATLGIPGFGYGIRYEYGMFRQQIVNGEQVEAPDYWLRAGNPWEFPRPEVTYMVHFGGRTVQRGDHVEWIDTEHVNATAYDTVIPGYDTDATNTLRLWSARATEELDLGAFNRGDYRNAVDTKNMSENVSRLLYPDDSTPAGRELRLRQEYFFVSATMQDLIRRYQRTHSTFGRFSEKVAVHLNDTHPVLAIPELMRLLVDVHRLQWDKAWNHVTQIFSYTNHTLMPEALETWDVEMLARLLPRHLEIIFEINAQFLKHVSEQSDHDGEMIRRISLVDEYGQRRVRMAYLAIVASQKVNGVSKLHSQLMTRDIFADFARIYPDRFTNVTNGITPRRWLAQASPSLSSLIDQKIGRHWRTNLFELEQLRELRNDSGFIDAFREAKRQNKLRLVHRLAHHTKLHFDPDALFDLQVKRIHEYKRQLLNVLHVIVRYNQIRANPERDWVPRVVLFAGKAASAYRMAKSIIKLIGDVSQKVNHDPLIGDRMKVVFVPNYGVSVAELIIPAADLSEQISMAGTEASGTGNMKLALNGALTIGTMDGANIEICDAVGRENMFIFGYTADEVDRLRATGYRPRQIYEENPELRMALDQIRSGFFSPDDPLRFADIFHTLVDWGDHYMVLADFAAFAKAQDEVDARFVDKRAWTESAIENVAGMGQFSSDRTIGEYARNIWHVSPLNIE

SEQ ID NO: 5545 - protein, 541 aa, Zea mays
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVFAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMV

SEQ ID NO: 5546 - protein, 369 aa, Streptomyces avermitilis MA-4680
MSFGIDDLPVRDELRGKSPYGAPQLDVPVRLNTNENPYPLPEPLVERIAERVREAARHLNRYPDRDAVELRTELATYLTNTGKHPVGIENVWAANGSNEVIQQLLQTFGGPGRTAIGFEPSYSMHALIARGTGTAWISGPRGEDFTIDLAAARQAIAESRPDVVFITTPNNPTGTAVPPETVLALYEAAQAVKPSMVVVDEAYIEFSHGDSLLPLLEGRPHLVVSRTMSKAFGAAGLRLGYLAAHPAVVDAVQLVRLPYHLSAITQATALAALEHTDTLLGYVEQLKAERDRLVAELRAIGYDVTESDANFVQFGRFADAHEVWQQILDRGVLVRDNGVPGWLRVSAGTPEENDAFLDAVRELKKEQNA

SEQ ID NO: 5547 - protein, 236 aa, Rickettsia sibirica
MIDYTKTLTAASKNKTFDEGLRQYMLKVYNYMALALLLTGVAAVTTISVEPIYNLMFQTGFGTIIMFAPLGIALYFFMGFGQMNLPTAQILFWVYAGLTGMSLAYLALIYTGASIARTFFICSSVFGAMSLYGYSTSRDLTSMGSFFAMGLIGLIIASLVNLFLKSSALSFATSLIGIVIFMGLIAWDTQKIKSMYYMAGNDEVGQKLSIMAAFTLYLDFINLFLYLMRFLGNRRD

SEQ ID NO: 5548 - protein, 164 aa, Zea mays; identical to SEQ ID NO: 4781

SEQ ID NO: 5549 - protein, 848 aa, Synechocystis sp. WH 8501
MSTLTPKVKNTSTSPEKTNIKIEDDRTGMNKETLKRAFLDHLFYIQGVDRSKASLRDYYMALSYTVRDRLLHRFLKTIETYKKEEVKIVSYFSAEFLMGRHLGNNLVNLGIYDTMKDIMTEMKIDFEDIIEQEPDPGLGNGGLGRLAACFLDSLASLAMPAIGYGIRYEFGIFHQTIQDGWQVEIPDNWLRFENPWEIARPDDAVEIKLGGHTEHTHDENGNPKTFWVADSTILAVPYDTPVPGYDTNTVNPLRLWKAEASENFNFEAFNAGQYDRAVQEKMDAETISKVLYPNDNTPAGRKLRLEQQYFFVSASLQDLIRIHLRNHNNLDHFADKVAVQLNDTHPAVAVAELMRLLMDKHNYQWEKAWEITTKALAYTNHTLMPEALERWPVSIFGELLPRHLEIIYELNHRFLEDQRTYFPGDDDLITNISLIEEREEKLIRMANLACLGSHAINGVAALHTELLKQDTLKHFAKLWPEKFFNKTNGVTPRRWILLSNPKLSALVTEKIGDGWLKNLDEMRKLEKFADDAAFRKQWREIKQQNKQSLADYLLKYRNIKIDPNTMFDVQVKRIHEYKRQHLMVLEIINLYNRIKENPNADYVPRTFLFGGKAAPGYFMAKLIIKLINAVADVVNNDPDVRGRLNVVFMPNFNVSLGQRVYPAADLSEQISTAGKEASGTGNMKFAMNGALTIGTLDGANIEIREEAHPENFFLFGLTAHEVYDRKAQGYSPSEYYHNNGSLKAVIDRISSGHFSHGNGELFGPIVEQLMNDDPYMLMADYQAYVDCQDAVSEAYRDQENWTRMSILNSARMGKFSSDRTIAEYCSEIWNVKPVDIKIAEYNPNGANN

SEQ ID NO: 5550 - protein, 615 aa, Pseudomonas fluorescens PfO-1
MLWMSVHRDVIRNEKMRSDMTVTVGDFLVERLSQWGVTRIFGYPGDGINGVFGTLSRAGGKIEFVQARHEEMAAFMASAHAKFTGELGVCIATSGPGASHLITGLYDARLDHMPVLAIVGQQARTALGSHYQQELDLVSMFKDVAGAFVQQASAPSQVRHLLDRAVRTAIGERRVTALILPNDLQDLEYKAPARAHGTAHSGVGYSKPKVLPYDADLQRAADVLNAGEKVAILVGAGALHASEQVFAIAEKLGAGVAKALLGKAVLPDELPWVTGCIGLLGTEPSYKLMTECDTLLMIGSGFPYAEFLPKEGQARGVQIDLQPDMLSLRYPMEVNLAGDAAETLAALAPLLEHKPLRKWRKKIEGWRASWDKTLEKRAMAKADPVNPQRVVYELSPRLPEQAIITSDSGSCANWFARDLKIRKGMKCSLSGGLASMGAAVPYAIAAKFAFPQRPVIALVGDGAMQMNNMAELITVAKYWRQWDSPKWICAVFNNEDLNQVTWEQRVMEGDPKFGASQSIPDVPYHLFAISIGLKGIFVDREEDVAAAWEQALASEVPVVIEFKTDPNVPPLPPHIKLEQAKKFASTLLKGDPDEAGVIVQTAKQVLGTVLPGKRK

SEQ ID NO: 5551 - protein, 525 aa, Glycine max
  unsure (1)..(525): unsure at all Xaa locations
MTSHIDDNLWIIALTSKCTQENLAWVLLIMGSLWLTMTFYYWSHPGGPAWGKYYTYSPPLSIIPGPKGFPLIGSMGLMISLAHHRIAAAAATCRAKRLMAFSLGDTRVIVTCHPDVAKEILNSSVFADRPVKESAYSLMFNRAIGFASYGVYWRSLRRIASNHFFCPRQIKASELQRSQIAAQMVHILNNKRHRSLRVRQVLKKASLSNMMCSVFGQEYKLHDPNSGMEDLGILVDQGYDLLGLFNWADHLPFLAHFDAQNIRFRCSNLVPMVNRVVRTIIAGHRASNTETNRDFVDVLLSLPGPGQLSDSDMIAVLWEMIFRGTDTVAVLIEWILARMALHPHVQSKVQEELDAVVGKXRCAVAEEDVAATAYLPAVVKEVLRLHPPGPLLSWARLAITDTTIDGYNVPAGTTAMVNMWAIGRDPEVWLDPLDFKPERFMGLEAEFSVLGSDLRLAPFGSGRRTCPGKTLGLSTVTFWVARLLHEFEWLPSDEGKVDLTEVLRLSCEMANPLYVKVRPRRGLST

SEQ ID NO: 5552 - protein, 178 aa, Glycine max
  unsure (1)..(178): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELEHGFIYHKHNKSPXYYNRHYXTMWKLPMFGCTDASQVLKELQXANTAYPNSFIHIIRFDNIHQIHCISFITYKLPSF

SEQ ID NO: 5553 - protein, 309 aa, Streptococcus pneumoniae
GFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEM

SEQ ID NO: 5554 - protein, 108 aa, Oryza sativa (indica cultivar-group)
DDDVVVACVVKAADAAAEGTFVKFLCSYGGRILPRHADGALRYVGGDNRVVSVDRSLPFHELQRKLREMCGWEAVCLRCQLPTEDLDALVSVTGDDDLANLLEEYDAA

SEQ ID NO: 5555 - protein, 179 aa, Zea mays
SKLSDKKKKKKKKKKKKKKKKNPRPQHNRLAFPSPPARLSLLSDSLSRSRVHLAAASKRDQRAPLGDGGAAAAAASNNLGGSFGEMLIDFVPDGAGLSLAESGGFVKAPGGGPANVAGAIAKLGGSSAFEGKFGDDEFGHMLGNILKQNNGNAEGGLFDKHARTALAFGTLKHDGEGEF

SEQ ID NO: 5556 - protein, 335 aa, Bartonella henselae
MSVRVAINGFGRIGRNILRAIIESGRQDIEVVALNDLGSVETNAHLLRYDSVHGCFPGTVQVVGDAIDIGSSLIKVFAERDPAQLPWKALDIDIALECTGIFTARDKASAHLDAGAKRVLVSAPSEGADLTVVYGVNHQFLSKEHHVISNASCTTNCLAPVAQVLHNTVGIEKGFMTTIHSYTGDQPVLDTMHRDLYRARAAALSMIPTSTGAAKAVGLVLPELKGLLDGVSIRVPTPNVSVVDLTFTAKRSTTIEEINTAIRTAAQGSLKGILDYTDEKLVSCDFNHNPHSAIFHNDQTKVIDGQLCRVLVWYDNEWGFSNRMCDTAVAFAKTI

SEQ ID NO: 5557 - protein, 164 aa, Vibrio cholerae O139
VTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAA

SEQ ID NO: 5558 - protein, 345 aa, Corynebacterium glutamicum ATCC 13032
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 5559 - protein, 279 aa, Nitrosomonas europaea ATCC 19718
MKKSILITGCSSGIGYYTAHGLHARGYRVFATARRQESVEMLLAEGLESFRLDLNDSDSIRWAVEETLRRSGGELYALFNNGGYGQPGAVEDLSREALRAQFETNLFGWVELTNLILPAMRRQGYGRIIQNSSVLGFTAMPFRGAYNASKYAIEGWSDTLRLELRGSRIFVSLIEPGPIITQFRANAMKAFERYIDVERSVHREKYLAIHNRLNKPGPAVPFTLPPEAVLKKVIYALEADTPKARYYVTFPTHLFGFLKRILPVSVLDKILAKAGNDHQ

SEQ ID NO: 5560 - protein, 1296 aa, Arabidopsis thaliana
MVFKNKLFFSSKKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRRKEAGSSKLGLEENMDRTRPSDNKSDRDSLSPDTGPPRSLSPTLPPSGSRLQNVASSSGTGRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWHHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 5561 - protein, 417 aa, Shewanella oneidensis MR-1
MSVKADPCSQPSLMHPDQAIPLMLEQVSPVSDTEVVSLPHALGRVLAEDLASCIDLPPFDNSSMDGYAFRFADLTSEAKQTTLTLIGSSFAGHGFEGRITPNSCVRIMTGAPVPAGYDTVQMQEETQANGDQIQINHPKAKGVNVRCQGEELLQGTKVLKAGIEINAAELGVLATIGVSQVRVYRQLKVAFFSTGDELRPVGSDLAPGQIYDSNRYSIQGLLSRANVEWLDLGVVSDDPEAIRHAFRHAASQADMVLTSGGVSVGEADFTKQILDEEGKITFWKLAIKPGKPFAMGRIGKAIFCGLPGNPVSSMVTFYKLVWPILNKMQGLTPKAPLMLSATLTTPVRKQPGRVEYQRGILSRNAQGELEVAITGSQGSGMLTSMSLANCFVQLEQFQGDTPAGSQVTVEPFNSVLC

SEQ ID NO: 5562 - protein, 314 aa, Clostridium perfringens str. 13
MNNKIRKAIIPAAGLGTRFLPATKAQPKEMLPIVDKPTIQYIIEEAIASGIEEILVITGRSKKSIEDHFDRNVELEMELEKSGKTELLDLVRDISDMVDIHYIRQKEPRGLGHAIYCAKTFVGDEPFAILLGDDVVYNEEKPCLKQLIDCYNEYRTSVLGVQTVPEENVSKYGIVNGKHIEGRVYKVKGLVEKPSPEEAPSNVAILGRYIVTPRIFDILENTKPGKGGEIQLTDALLELMSEEAMYAYDFEGRRYDVGDKLGFLEATVEYALRRPDLRDGFIDYLRELSATENIFTEANGKEKKDKEEELVTEA

SEQ ID NO: 5563 - protein, 989 aa, Trichodesmium erythraeum IMS101
  unsure (1)..(989): unsure at all Xaa locations
MVEQISHTNYETKTQEIAKQLLKATQEKNRSFLAQLQNQMRWDDKLLDWAMASPGLRVQLFRFIDCLPALRSKPEIAAHLQEYLTTQEVELPETLKKLLNFANPDSVPGQLAATTVAPAVETLAHKYIAGENVKQIIKTLEKLRKDKMCFTVDLXXXXXXXXXXXXXXXXXMTQLSQAANSWSSIPQIDEAEGEKLPRVQVSVKLTAFYSQFDPLDVKGSQERVSDHVRTLLRHAQKLGVAVHFDMEQYTYKDLTIDILKELLMEEEFRNRNDIGVTIQAYLRDSEKDLQGIIEWAKIRGRPVTVRLVKGAYWDQETIKALQHDWPQPVFNDKPETDANFEKLTYMMLENHEYIYSAIGSHNVRSQARAIAIAETLKVPRRCFEMQVLYGMGDKIATILAEKGYRVRVYCPYGDLLPGMAYLIRRLLENTANSSFLKQSLENRPLEELLAAPSINGKTTIHDVVKPVFPNAADSDYANFQQRQQALNTIGQIRLELGKTYLPIINGEYTNTAQIVDSLNPSNSKEVVGKIGLISVEQAEQAIQAAKAAFPSWKKTPVRERTRILRKAADLMEKRRHELAAWMVLEVGKPLNQGNAEVSEAIDFCRYYADEMERLEQGYNYDVAGETDRYYYQPRGISLVISPWNFPLAIPTGMTVSSLVTGNCTLLKPAAVSSVIASKISEILLEAGFPKGVFQFVPGNGSTVGDFMVKHPSVNSITFTGSMEVGCHIYAQAAVLQPRQKHLKRVIAEMGGKNAIIVDESADLDQAVAGVVYSAFGYSGQKCSACSRVVVLATIYDSFVNRLVEATRSLNIGDAEKPSTQVGPVIDEKAQKRIQEYIVKGKQEAEVAIEMSAPKDGYFVGPVIFKDVSPSATIAQEEIFGPVLAVMKADNFTQALEIANGTNFALTGGLYSRTPSHIEQAKAEFEVGNLYINRGITGAIVSRQPFGGFKLSGVGSKAGGPDYLLQFLEPRTITENIQRQGFAPIEGVDN

SEQ ID NO: 5564 - protein, 351 aa, ASPERGILLUS NIDULANS FGSC A4
MATPQLQTAAVLPSTGATLTSRLEIRHDRPIPSPAAGELLVKLEFSGVCHSDVHSVRGETPMLTDVAGHEGVGKVVKVGDGVDEGAWMGRRVGIRWLYSSCLECEICERNNTACPNQKNAGANVPGTFQQYIVSPAMHVTKIPPQLSPDEAAPLLCAGIAMYSSIMKTKTRPGDWIVFPGAGGGLGHMGVQIAVKKGLRVIAIDSGEKKQKLCLSLGATAFLDYKTDDVESAVKQLTSGLGAHAVICTANGEAAYEQSMRLLRRLGVLVCVGIPNLPFRLPATPFDMIVKGLTIVGNSAGTAEEMEELMEMAVAGDLKAHIECFEFDQIDDVIQRLGRSEIEGRAVMRIPE

SEQ ID NO: 5565 - protein, 162 aa, Arabidopsis thaliana
MSSEELRLVSPTIDNDGKLPRKYTMAGQGVKKDISPPLEWYNVPEGTKTLALVVEDIDAPDPSGPLVPWTVWVVVDIPPEMKGLPEGYSGNEDQTTGIREGNNDHKIPGWRGPLLPSHGHRFQFKLFALDDKPKIGHTVTKERLLIAIEGHVLGEAILTCLA

SEQ ID NO: 5566 - protein, 257 aa, Glycine max
DIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 5567 - protein, 242 aa, Halobacterium sp. NRC-1
MQAVVLAAGEGTRLRPLTEDKPKGMVEVDGKPILTHCFEQLVELGADGLVVVVGYRKQDIIEHYGDEFEGVPITYAHQREQKGLAHALLNVEEHVDEDFMLMLGDNIFQANLEDVVRRQQEERADAAFLVEEVDWDDASRYGVCDTNQYGEVTDVVEKPDDPPSNLVMTGFYTFSPAIFHACHLVQPSNRGEYEISEAIDLLIQSGRTIDAIGLEGWRVDVGYPEDREEAEERLAEAEDAVA

SEQ ID NO: 5568 - protein, 419 aa, Prionitis angusta
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTC

SEQ ID NO: 5569 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYERTHASTIAVMPVPHEDVSAYGVIAPQGEGINGLYSVETFVEKPAPEDAPSDLAIIGRYLLTPEIFEILEKQAPGAGNEIQLTDAIDTLNKTQR

SEQ ID NO: 5570 - protein, 706 aa, Nicotiana tabacum
TLTHTTSLFAPPNLSPMQDFIGSVRRSLVFKQSGDFDTGAAGVGSGFGGFVEKLGSSIRKSSIGIFSKAHVPALPSISKAELPAKARKDDTPPIRWRKGEMIGCGAFGRVYMGMNVDSGELLAIKEVSIAMNGASRERAQAHVRELEEEVNLLKNLSHPNIVRYLGTAREAGSLNILLEFVPGGSISSLLGKFGSFPESVIRMYTKQLLLGLEYLHKNGIMHRDIKGANILVDNKGCIKLADFGASKKVVELATMTGAKSMKGTPYWMAPEVILQTGHSFSADIWSVGCTIIEMATGKPPWSQQYQEVAALFHIGTTKSHPPIPEHLSAESKDFLLKCLQKEPHLRHSASNLLQHPFVTAEHQEARPFLRSSFMGNPENMAAQRMDVRTSIIPDMRASCNGLKDVCGVSAVRCSTVYPENSLGKESLWKLGNSDDDMCQMDNDDFMFGASVKCSSDLHSPANYKSFNPMCEPDNDWPCKFDESPELTKSQANLHYDQATIKPTNNPIMSYKEDLAFTFPSGQSAAEDDDELTESKIRAFLDEKAMDLKKLQTPLYEGFYNSLNVSSTPSPVGTGNKENVPSNINLPPKSRSPKRMLSRRLSTAIEGACAPSPVTHSKRISNIGGLNGEAIQEAQLPRHNEWKDLLGSQREAVNSSFSERQRRWKEELDEELQRKREIMRQAVNLSPPKDPILNRCRSKSRFASPGR

SEQ ID NO: 5571 - protein, 380 aa, Picea abies
NNVNPIKEVQDSPKEPNPITEQISVHADCKQTVEKPNENEIVVSANKAAVASLKQQSTLQSPRISRQPKTSLNQGNPVPLAKLHEDAGRSSSLDFVNIDSEYKDPQMCTAYVTDIYANMRVVELKRRPLPNFMETIQRDINANMRSVLIDWLVEVSEEYKLVPDTLYLTISYIDRFLSANVVNRQRLQLLGVSCMLVASKYEEICAPPVEEFCYITDNTYKKEEVLDMEINVLNRLQYDLTNTKPLRPFSGVSFEQLKHPVRFQACIWEFMGNYLAELTLVEYDFLKYLPSLIAAAAVFLARMTLDPMVHPWNSTLQHYTGYKVSDMRDCICAIHDLQLNRKGCTLAAIRDKYNQPKFKCVANLFPPPVISPQFFIDNEV

SEQ ID NO: 5572 - protein, 429 aa, Brucella melitensis 16M
MQPRAGPSLPGAKRLPKERIAYIRRIAEIYESRLDEMAKTISMEMGAPIKLARESQAAAGLSHTKAFIAACENFEVEEVLSPKYPNQTVVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTGQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 5573 - protein, 197 aa, Glycine max
  unsure (1)..(197): unsure at all Xaa locations
MAKKSQKSLNSTGKRTRKSVPRDSPPQRSSIYRGVTRHRWTGRYEAHLWDKNCWNESQSKKGRQVYLGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAXIEYRGXLNPVTNFDPEPF

SEQ ID NO: 5574 - protein, 302 aa, Gloeobacter violaceus
RIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVIS

SEQ ID NO: 5575 - protein, 458 aa, Eupogodon spinellus
  unsure (1)..(458): unsure at all Xaa locations
PNYVINETDILALFRVSPQRGVDPVEASAAVAGESSTATWTVVWTDLLTACDLYRAKAYKVDAVPNTTDQYFAYISYDIDLFXXXXXXXXXXXXXXXXXGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEEMYERAEFAKQLGTVIIMIDLVIGYTAIQTMGIWSRKNDMILHLHRAGNSTYSRQKIHGMNFRVICKWMRMAGVDHIHAGTVVGKLEGDPLMIRGFYNTLLWSHLEINLPQGIFFKQDWASLRKVTPVASGGIHCGQMHXLLDYLGNDVVLQFGGGTIGHPDGIQAGATANRVALEAMVIARNEGRPYVAEGPEILVEAAKTCGPLQTALDLWKDISFNYTSTDTADFVETSTSNV

SEQ ID NO: 5576 - protein, 278 aa, Cetrariella delisei
  unsure (1)..(278): unsure at all Xaa locations
VEHGEVKVVAVNDPFIEPHYAAYMLXYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDLEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 5577 - protein, 205 aa, Fucus distichus
MSRNDSPFDMQIKLLMIGDTGVGKTCLLLRYANDSFSQTFITTIGIDFKIKNIDLDSKRIKLQIWDTAGQERFRTITTSYFRGAQGILLVYDVTDKKSFNSIRNWVAQIQQHADVAVNKILIGNKCDMDEDREVSKEEGANLAAEYGIQFFETSAKNDINVEKGFITIAREVKDRLMADGPGGGGGHGRTVDINGQASKKKTGCC

SEQ ID NO: 5578 - protein, 265 aa, Oryza sativa (indica cultivar-group)
  unsure (1)..(265): unsure at all Xaa locations
FFTDAYDLFCISLVSKLLGRIYYTDIASDTPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTRPGGAQLLLAHENARRTARYTGSXAQTPSKAGRXHXQGVXTRXFQXGXXAPGXRGVXRRXXPRXXKXGXFFXG

SEQ ID NO: 5579 - protein, 332 aa, Magnetospirillum magnetotacticum
  unsure (1)..(332): unsure at all Xaa locations
MNKPEFLADAKTKSPFSARYDNFIGGQWVAPAAGRYFENTSPITGKVICEVARSDAQDIEKALDAAHAAKDAWGRTAPAERARILNRIADRMEENLDLIALAETWDNGKPIRETTAADIPLAIDHWRYFASCVRAQEGAISEIDHDTVAYHFHEPLGVVGQIIPWNFPILMAVWKLAPALAAGNCVVLKPAEQTPASILVVLELIGDLLPPGVINVVNGFGLEAGKPLASSPRIAKIAFTGETTTGRLIMQYASQNLIPVTLELGGKSPNIFFGDVXNEDDDFFDKGLEGFTMFALNQCEVCTCPRPALVPKSSTTASRAPHKPSSNQQGRP

SEQ ID NO: 5580 - protein, 182 aa, Oryza sativa
  unsure (1)..(182): unsure at all Xaa locations
MAPSVMASSATTVAPFQGLKSTAGMPVARRSGNSSFGNVSNGGRIRCMQVWPIEGIKKXETLFYLPPLTVEDLLKQIXEYLLRSQVGCPCLEFSQVXGFVYREKPQGPPGYYXGRYWTMWXKLPMFGCTDXATQVLIGARGGHRRQYPDAFVRIIGFDNVRQVQLISFIAYKPPGCEESGGN

SEQ ID NO: 5581 - protein, 108 aa, Glycine max
  unsure (1)..(108): unsure at all Xaa locations
AASMISSPAVTTVNRAGAGMVAPFAGLKSMGGFPTIKTNSDVAFIASYGGRVQFKLVWPPVGNKMFYTLFFLPYLYDAQLAKEVXFLHRKGWITWLEFEWEHGFLCRE

SEQ ID NO: 5582 - protein, 438 aa, Neurospora crassa
MPISKIHARYVYDSRGNPTVEVDVVTELGLHRAIVPSGASTGQHEACELRDGDKTKWGGKGVLKAVQNVNEVIGPALIKENIDVKDQSKVDKFLIDLDGTPNKTKLGANAILGVSLAVAKAGAAEKGVPLYAHISDLAGTKKPYVLPVPFMNVLNGGSHAGGRLAFQEFMIVPSAAPTFSEALRQGAEVYQILKSLAKKKYGQSAGNVGDEGGVAPDIQNPEEALDLITEAIEKAGYTGQVKIAMDVASSEFYKEDVKKYDLDFKNPESDPSKWLTYEELANLYSELCKKYPIVSIEDPFAEDDWEAWSYFYKTQDIQIVADDLTVTNPLRIKKAIELKAANALLLKVNQIGTLTESIQAAKDSYADGWGVMVSHRSGETEDVTIADIVVGIRSGQIKTGAPARSERLAKLNQILRIEEELADNAIFAGEKFRKAVEL

SEQ ID NO: 5583 - protein, 235 aa, Zea mays
MPSQSTHTSSSLSSSTTPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 5584 - protein, 364 aa, Hordeum vulgare subsp. vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHHSSLLAAYLDCQKVGAPPEVSARLTAVAQDLELRQRTALGGLGTATEPELDQFMEAYHEMLVKYREELTRPLQEAMEFLRRVETQLNSLSISVRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 5585 - protein, 477 aa, Mycobacterium tuberculosis H37Rv
MDQFPIMGVPDGGDTAWMLVSSALVLLMTPGLAFFYGGMVRSKSVLNMIMMSISAMGVVTVLWALYGYSIAFGDDVGNIAGNPSQYWGLKGLIGVNAVAADPSTQTAAVNIPLAGTLPATVFVAFQLMFAIITVALISGAVADRLKFGAWLLFAGLWATFVYFPVAHWVFAFDGFAAEHGGWIANKLHAIDFAGGTAVHINAGVAALMLAIVLGKRRGWPATLFRPHNLPFVMLGAALLWFGWYGFNAGSATTANGVAGATFVTTTIATAAAMLGWLLTERVRDGKATTLGAASGIVAGLVAITPSCSSVNVLGALAVGVSAGVLCALAVGLKFKLGFDDSLDVVGVHLVGGLVGTLLVGLLAAPEAPAINGVAGVSKGLFYGGGFAQLERQALGACSVLVYSGIITLILALILKFTIGLRLDAEQESTGIDEAEHAESGYDFAVASGSVLPPRVTVEDSRNGIQERIGQKVEAEPK

SEQ ID NO: 5586 - protein, 478 aa, Rickettsia sibirica
MISNFFNLIRIFRIISKKQILIDSRSPKYCRFIGYILALFFAPVSLIKKSREDYGKRLIDCLSDLGPIYIKFGQTLSTRADLVGTEIAGYLRLLQDNLPPFDGGVARRLITSLRGDIYVDEAISASKQKIATQSMTVSHDALPFLHLDDTPIAAASISQVHKAQLITGEYVAVKILRPGIHKKYNRDIKLLYFLAKIISKFSKAKRLKPIKVVDKFHETMKFELDLRLEAAAASELTDNMRNDINVIIPKIYWDLTSENILTTEWLDGTSIYDTLLLKEMGLEPAKISQDFAVMFFNQAYRDGFFHADLHAGNILVNKQGKIILLDFGIMGRLKEKDRLAVAESLFGFLRRDYKLVAKVHLRAGYIPSNTDLALFAQSCRAVTEPIVGTPIKNISIGKLLAHLFKITEDFGMEVQPELLLLQKTLIMVEGIGRQLDGNVNMWQLAEPWIKKWAVKNLSPEAKLLRLVKHDLDSLEDII

SEQ ID NO: 5587 - protein, 479 aa, Mastocarpus pacificus
RIKNERYESGVIPYAKMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRSVAASGEIKGHYLNITAATMEDMYERAEFAKQLGSIIIMIDLVIGYTAIQSMAIWSRRNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMIIARNEGRDYVAEGPQILQDAAKTCGPLQTALDLWKDITFNYTSTDTADFVETPTANV

SEQ ID NO: 5588 - protein, 315 aa, Escherichia coli CFT073
MSFKLTKDDKIKQDKTNMTRIACVGITVQDRIYSLPTLPEGGGKYQANHYLEIGGGPAATAAVAIAKLGVEVDFIGRIGDDSCGNTLLAELEGWGVNTAFCRRYPNARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 5589 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 5590 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 5591 - protein, 477 aa, Glycine max
  unsure (1)..(477): unsure at all Xaa locations
MDSACATLNGRHLAKVSEGIGRNRTSGFWGESTRGSVNTKRFLSVQSCKTSRTNRNLRNSKPGSGIARAVLTSDIDEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYIASMGVYVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKXPIGVGQILNQ

SEQ ID NO: 5592 - protein, 356 aa, Methanopyrus kandleri AV19
MNVDAVVLAGGFGTRLRPLTWDTPKPLVPILGKPLIEWVIRSLPRDVVHVHIAAGFSSEKLERYVESDPLPRKLHLKVEPKPLDTAGAIKFACRDSTADAFVAFNGDIVSSLDVRQMLKFHREHDGIATIALYPVPEDEVSRFGVVDLDDDDRILDFVEKPEPEEAPSNLINAGAYVLDREVLDYIPEGRPVSIEREIFPKLAEEGLLYGFKFEGYWVDVGLPETYLEAHRVLMEHECSGKSVVGARITDTDLKPPVVAAPMTELRSSEIGPYVYVGERTEINGSVIENSVILDDVEIIDSEVRNTIVAEGCKIENARLDGCVLGHDAEVCGCNLKGVRVAPGKEAERDLEDEWVI

SEQ ID NO: 5593 - protein, 457 aa, Dictyota cervicornis
  unsure (1)..(457): unsure at all Xaa locations
DYNVKETDILALFRITPQPGVDPVEAAAAVAGESSTATWTVVWTDLLTACDIYRAKAYRVDPVPGTSDQFFAYIXYECDLFEEGSLANLTASIIGNVFGFKAVKALRLEDMRIPFAYLKTFQGPATGVIVERERLDKFGRPLLXATVKPKLGLSGKNYGRVVYEGLCGGLDFLKDDENINSQPFMRWKERFLYCMEGVNRAAAATGEVKGSYLNVTAATMENMYXRADYANSLGTVIVMIXLVIGYTAIQSMAIWARKAQMILHLHRAGNSTYARQKNHGINFRVICKWMRMSGVDHIHAGTVVGKLEGDPLMVRGFYNTLLLTELKVNLAEGIFFDMDWASLRKCVPVASGGIHCGQMHQLLYYLGDDVVLQFGGGTIGHPDGIQSGATANRVALEAMVLARNEGRDYVAEGPEILRTAAATCGPLKTALDLWKDISFNYTSTDTPDFVETPTGSK

SEQ ID NO: 5594 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 5595 - protein, 170 aa, Metroxylon sagu
MGIYVFKTDVPLKLLRWHYPTANDFGSEIIPMAAKDYNVQAYLFDEYWEDIGTIKSFFDANLALTDQSPKFRFHDPKKPIFTSPRFLPPTKIEKCRVVDSIISHGCFLTQCSVEHSVIGIRSRLEHGVELKDTMMIGADYYQTGAERASLLAEGKVPVGVGENTKIRNCI

SEQ ID NO: 5596 - protein, 351 aa, Saccharomyces kluyveri
MSAPQIPETQKAVIFYENGGELQYKDIPVPKPKSNEILINIKYSGVCHTDLHAWKGDWPLPTKLPLVGGHEGAGIVVGMGENVKGWKIGDYAGIKWLNGSCMSCEYCELSNESNCPDADLSGYTHDGSFQQYATADAVQAARIAPGTDLAEVAPVLCAGITVYKALKSANLRAGEWVAISGACGGLGSLAIQYAKAMGYRVLGIDGGDEKAALFKELGGEVFIDFTKTKDVVKAVVDATNGGAHGVINVSVSEAAIEASTVYCRANGTVVLVGLPGGAKCKSDVFNQVVKSISIVGSYVGNRADTREALDFFSRGLVKSPIMIVGLSELPSIYEKMEKGAIVGRYVVDTSK

SEQ ID NO: 5597 - protein, 124 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGINNKIHPGEAMDKNLY

SEQ ID NO: 5598 - protein, 103 aa, Desulfitobacterium hafniense
MPWALALFRCVNRDKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 5599 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWDPKY

SEQ ID NO: 5600 - protein, 322 aa, Schizosaccharomyces pombe
MSSLEQLKATGTVVVSDTGDFESIAKYKPQDATTNPSLILAASKKPQYAALVDAAVDYAKAKGGSINSQIEIAFDRLLIEFGTKILAIVPGRVSTEVDARYSFDTQTTIEKARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKKFGYKTIVMGASFRNVGEIKELAGVDFLTISPALLEQLNNSTDAVPKKLDASKASSLNLEKVSYLTDEPKFRFDFNNDEMAVVKLSTGIAAFAKDADTLRTILKAKLEA

SEQ ID NO: 5601 - protein, 441 aa, Streptomyces ansochromogenes
MYELLKTIMIEELEVEAGQVSPDASREDAGLDSLATFELSLALSQRLGVTIADEDLFGLRTLADIAEFLEKRTAGLPGSPGASGSQAADRAEDREHAGLARLLGCGDDVHPDRPGGPAHQLARNETPFQPSAPVLDAITRAAAEANRYPDPACGALRAALARHYGLSPDRVAVGAGSITLLQALLTVTAAPGAAVAYSWPSFDGYEVLADLAGFRTVRVPLAEDGHDLDALAAAVDEHTRLVLLCNPNNPTGTASGETDLLRFLDAVPRTCLVLLDEAYCEYARDPGLGARLLTSRPNLIVARTFSKAHGLAGLRVGYLLAEPGLISRVHRMVMPLSVSDVAQAAAVASLAAEKELLGRVRETVAERDRVRAALLALGFDVPPSEANFLWLPLGARAQEFAAACASAGVDVRPYPGDGVRVTTGTAEDNDAFLAAAETNRP

SEQ ID NO: 5602 - protein, 129 aa, Oryza sativa
  unsure (1)..(129): unsure at all Xaa locations
MDPCTLRATSSFDTNTTTTNARAPGRNDNEALTEASRGPILLEDYHXLIEKVSHFARERMLERVXHARVAYAKGFFESTHNVTDITCAHFLRPPSAHTPAIARFYTVIHERVLPETIRDPSGLVARFYI

SEQ ID NO: 5603 - protein, 306 aa, Mycobacterium tuberculosis CDC1551
MGTRGGTMDPAGNPATGTARVKRGMAEMLKGGVIMDVVTPEQARIAEGAGAVAVMALERVPADIRAQGGVSRMSDPDMIEGIIAAVTIPVMAKVRIGHFVEAQILQTLGVDYIDESEVLTPADYAHHIDKWNFTVPFVCGATNLGEALRRISEGAAMIRSKGEAGTGDVSNATTHMRAIGGEIRRLTSMSEDELFVAAKELQAPYELVAEVARAGKLPVTLFTAGGIATPADAAMMMQLGAEGVFVGSGIFKSGAPEHRAAAIVKATTFFDDPDVLAKVSRGLGEAMVGINVDEIAVGHRLAQRGW

SEQ ID NO: 5604 - protein, 221 aa, Solanum tuberosum
MVRQKIQIKKIDNLTARQVTFSKRRRGLFKKAQELSTLCDADIGLIVFSATGKLFEYSSSSMMQLIEKHKMQSERDSMDNPEQLHSSNLLSEKKTHAMLSRDFVEKNRELRQLHGEELQGLGLDDLMKLEKLVEGGISRVLRIKGDKFMKEISSLKKKEAQLQEENSQLKQQSQARLNEEGQNVIEQGHSADSITNNRSLVNSHQDYNDSDTSLKLCLAFP

SEQ ID NO: 5605 - protein, 472 aa, Gymnogongrus turquetii
ESGVIPYAKMGYWDPDYVVKETDVLALFRVSPQPGVDPVEASAAIAGESSTATWTVVWTDLLTACDLYRAKAYKVDAVPNTSDQYFAYVAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQSMAIWARANDMILHLHRAGNSTYSRQKIHGMNFRVICKWMRMAGVDHIHAGTVVGKLEGDPLMIRGFYDTLLLPYLKVNLPQGYFFEQDWASLRKVTPVASGGIHCGQMHQLLDYLGIDVVLQFGGGTIGHPDGIQAGATANRVALESMVIARNEGRDYVAEGPEILQNAAKTCGPLQTALDLWKDITFNYTSTDTADFVETPTANV

SEQ ID NO: 5606 - protein, 245 aa, Oryza sativa
MAPTTPASFLRPPPLPHHHHPRIVRLPPPSATFRVADLLGGRGLCNGEVGIRKELASDSPAAPPSTTTSSDEPAESPPPPPAASGVDPDAFDKEMMGLTGGFPGGEVGLKDFVAKNPPPPKPAHRKGLAAAATVERPRAPELPLFLPGMVVLVKNPNNAYHMYCGIVQRVTDGKVGVLFEGGIWDRLITFDLDELEGREKGPPMVNPKSVLLESLAAEMEDDVAKEEEGEEAKKKKEEEGTAAAA

SEQ ID NO: 5607 - protein, 680 aa, Burkholderia fungorum
MDHSSTSSAIMSAPAPAASRFAPGRSRDIVCLGRLAVDLYAQQVGARLEDVSSFAKYLGGSSANIAFGCARLGLASSMLARVGNDHMGRFLTETLTKEGCDVSHVRIDRERLTALVLLGLKDRDTFPLIFYRENCADMAVDEADFDEAFIASSKALLITGTHFSTEQVNRTSRRALDYARRNQVRTVLDIDYRPVLWGLTGKADGETRFVASEGVTAHLQRILPLFDLVIGTEEEFRIAGGKTELVDALAMVRAVTPATLVLKRGPLGCQIIDGQVPASLDNVPIHGGVEVEVLNVLGAGDAFASGFLSGWLRDQPLEACARAANASGALVVSRHGCAPAMPTPAELDYFLREAKADPQRMRRPDRDAALARLHRVSPARKQWDEVLGFAFDHRNQFFELAQQTGADEARIARLKGLFVEAVAQTESALGLQNRIGVLIDDRYGQDALNAATGRGWWIGRPVELPGSVPLVFDHGRSIGTTLIPWPQEHIAKCLVQFHPDEPIEQRLEQEAQLRALYDATQASGHELLLEVIPPKHAHLPQAPDVVYRALKRLYNIGIYPEWWKLEPMDAAQWRSVDALIAERDPYCRGVVLLGLSAGVEQLNEGFRAAAQSATCRGFTVGRTIFHEPSHAWLAGEIGDDELIARVRRTFETLIASWRATRGAGAAQPGTPNPVHQEQAA

SEQ ID NO: 5608 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIPLAKTNWLR

SEQ ID NO: 5609 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNVISGFGPTAGAAIASHMDIDKLAFTGSTETGKVVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 5610 - protein, 131 aa, Brassica juncea
ILDRYGKQHADDVKALDFQSRALNYGSHNELLELVESTLVESNVDVSVDSLVQLEGHLENALSLTRARKTELMLKLVDSLKEKEKLLKEENQALASQMEKKNTAGAEADNMETSPGQISDINLPVTLPLLN

SEQ ID NO: 5611 - protein, 305 aa, SYNECHOCOCCUS SP. WH 8102
MVWTVDDIPSQEERVALVTGANSGLGLATARAMSARGATVIMACRCRRKAETARTQLLEAGLTGLDLLDLDLADLNSVRRAAAEVSDRYGHLDLLFNNAGVMAPPRQLTVQGHELQLGVNHLGHMALTLQLLPLMQGRNDARVVTVTSGAQYFGRIRWDDPSWAQGYDRYGAYSQSKLANVMFALELEARQQEQGGGIRSLAAHPGLARTDLQPTAIASGGNRLEAVAYRLMDPLFQSAAMGALPQLHAATAATAQGGEHYGPDQLGGMRGHPTRCRIAPAALDREQRQRLWQLSEELAGGLLMP

SEQ ID NO: 5612 - protein, 144 aa, Candida glabrata
MAISPQKISEIFENLNVSSNNVTTQSNSRLTREQKHALQLEADACSIYIGNISLDTTPEEIDEHFKSCGVIKRITMLYDKNTGPSIGYAYVEFDSIDSRDKALDFNGTNLRQHVISVERKRTNIPNYKQNTSNNTDSGTENKNT

SEQ ID NO: 5613 - protein, 178 aa, Glycine max
GGHVPIYDFKKHQRSSDSFRQVNGSDVIILEGSLVFHDQRVRDLMNMKIFVDTDADVRLARRIRRDTMERGRDINSVLEQYAKFVKPAFDDFVLPSKKYADVIIPRGGDNHVAIDLIVQHIRTKLGQHDLCKIYPNAYVIQSTFQVSLNLVCQFYYFILFSTFYDLKFGEDPVAHPYN

SEQ ID NO: 5614 - protein, 170 aa, Glycine max
  unsure (1)..(170): unsure at all Xaa locations
RSXXVFHYGSISLIVXXCRSAHLKAMXVAKESGCLXXYDPXXRLPLWXXAEEARKQILSIWEKADLIKVSDAELEFXLGEHGSRYYTKSFKGSVDAFHVNTVDTTGAGDSFVGALLAKIVDDQSILEDDPRLREVLKFANACGAITTTQKVAIPALPKEEVALNLIKGGS

SEQ ID NO: 5615 - protein, 60 aa, Zea mays
  unsure (1)..(60): unsure at all Xaa locations
TKLMNAYCDRQPVEMIAIPLLXFDGHRLRAEHTPDDMYMDDAHKIEAMIHQTDNTCPTTT

SEQ ID NO: 5616 - protein, 86 aa, Oryza glaberrima
GKARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 5617 - protein, 502 aa, Avicennia marina
  unsure (1)..(502): unsure at all Xaa locations
MAIRIPSRQLFIDGKWREPVNRKRLPIVNPATEETIGDIPAATAEDVNIAVEAARKAFFHNGGKDWATASGAHRAKYLRAIAAKVTEKKEELAKLEVLDCGKPLEEAAWDMDDVAGCFEYFADLAERLDSNQIPVSLPMDTFKCHVLKEPIGVVGLVXPWNYPLLMATWKVAPALAAGCTAILKPSEIASVTCLELAQVCKEVGLPAGVLNILTGLGPEAGAPLASHPHVDKITFTGSGATGSKIMTAAAQLVKPVTLELGGKSPIVVFEDVDLDTAAEWTLFGCFWTNGQICSATSRLLVHESIATTFLEKLVKWCEKIKISDPLEEGCRLGPIISRGQYEKVMKFISTAKEEGATILCGGARPEHLEKGYFVQPTIITDVKTSMQIWIEEVFGPVLGVKTFSKEDEPFELANDPHYGWAAAVLSQDLERCERMTKAFQAGIVWVNCSQPCFCQAPWGGKKRSGFGRDLGEWGLDNYLNVKQVTRYVSSEPWDWYKSPSKL

SEQ ID NO: 5618 - protein, 1110 aa, Desulfovibrio desulfuricans G20
MSIMIEPAGLDPQWYRDAIIYELHIKSFHDSDGDGMGDMAGLIEKLDYLQDLGVTALWLLPFYPSPLRDDGYDIADYMSINPDYGSMADFRKLLREAHSRGLRVITELVLNHTSDQHAWFRRARRAPAGSEERDFYVWSDTSDRYKDARIIFKDFEPSNWSWDPVARAYYWHRFYHHQPDLNYENPAVHKAMFRVIDFWLDMGVDGVRLDAVPYLYEEEGTNCENLPRTHDFLKALRSHIDSRFQGRMLLAEANQWPEDAARYFGDGDSCHMAFHFPLMPRMFMAIEMEDRHPVIDIMEQTPELPDGCQWAIFLRNHDELTLEMVTDEERDYMYRMYARDPRARINLGIRRRLAPLLGNDRRRVELLNVLLFTMPGTPVLYYGDEIGMGDNYYLGDRDGVRTPMQWSADRNAGFSRSNPQRLFLPVVIDPEYHYEAVNVETQQSNKSSLLWWMKRIIAMRRRYTAFSRGGISFLRPENSRVLAYMRSSGEEHVLVVTNLSRHAQAASLDLSGWEGYRPVEVFSNTRFPAVRQPAYTITLNPYGYYIFHMRREEAAEALTGLFSPPMLMPVSGARFLDVEVREALQRRVLPGYLTRRGLLGTSAVQLREAVILEAVPVGGKGAPSWLLIVEARYQERQPEWFGMLVSLLAGEPARQTVREAPVHLMCTFGEDAPEAVLVESFDASCRCGALLQLVSRTQTVKGRHGELAVAPAGGTRGRVRAACAEDAPALWKPHIHATSVVCGESVLFKVYRRMDEGVNPDVELLRFLTEEAGYPHVPAYMGVVEYRRSRTSSMAVAMLHEYVQAQGDAQEMCRDMVRRFFDRVLAARGEMDIRPRLYARSPVEAAGRPLPQEYRELMGDMDFAGMQLLGRRVGELHRALAFSSEDSAFAPEPFSTLYQRSVYQGMQSRVKQVLTRLERSLALLPESARDDAARVLELREEALRRMRGFLTRKLDCLKIRVHGNLHLGNVLRSGREYVIVNFEGRPDKSLSERRLKRSPLRDVADLVRSVHYTVLTVLMHESVLRPEDRAFLEPWADLWRIEASGAFMTTYLEAVGGSRLVPENEQGVQVLLEAFLLEKAFMELDAELKAPSGMVGLPLAAIITLLGAEG

SEQ ID NO: 5619 - protein, 306 aa, Photobacterium profundum
MKPTKELLAGILDEVRPLIGQGKVADYIPALAGISATKLGIAVCYNDGEIIQAGDTQERFSIQSISKVMSLTLAMSLYEPEEIWRRVGKEPSGHAFNSMIQLELENGIPRNPFINAGALVVSDLLHSRLAAPQYRMLELVRKLSCNPHLTYDKAVAASEMQHSDRNASIAYLMRSFGNFENEVMPVLTNYFSYCSLNMSCIDLARTFSYLANKGLPLGAKKTIISQTQSKQMNALLATCGLYDGAGEFAYRVGMPGKSGVGGGIVAIVPGEMSITVWSPELDPSGNSLAGTAALELLAERIGRSIF

SEQ ID NO: 5620 - protein, 361 aa, Schedonorus arundinaceus
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMDAAMDSLDYIIDTVPVKHPLEPYLALLKMDGKLVLMGVIAEPLSFVSPMVMLGRKTITGSFIGSIEETEEVLRFCVEKGLTSQIEVVKMDYLNHALERLERNDVRYRFVVDVAGSNIKDADA

SEQ ID NO: 5621 - protein, 479 aa, Hymenena flabelligera
  unsure (1)..(479): unsure at all Xaa locations
RLKNERYEPGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAXXXXDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLFSQLEVNLPQGIFFKQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVETPTANV

SEQ ID NO: 5622 - protein, 163 aa, Vitis vinifera
CWRSVLIQTEPRTRLDAGTWGTMGVGLGYCIAAAVASPDRLVVAVEGDSGFGFSAMEVETLVRYQLPVVVIVFNNGGVYGGDRRNPEEVTGPYKDDPAPTSFVPGAAYHVLIEAFGGKGYLVGTPDELKSALAESFSSRKPAVINVTIDPYAGAESGRMQHKN

SEQ ID NO: 5623 - protein, 169 aa, Glycine max
  unsure (1)..(169): unsure at all Xaa locations
MAGGQLGVLNALDVAKTQWYHFTAIVIAGMGFFTDAYDLFCISLVTKLLGRLYYTDITNPKPGVLPPNVQAAVTGVALCGTLAGQLFFGWLGDKLGRKRVYGLTLMLMVVCSVASGLSFGDTPKGVMATLCFFRFWLGFGIXGDYPLSATIMSEYANKKTRGAFIAAVF

SEQ ID NO: 5624 - protein, 437 aa, Chlorobium tepidum TLS [sequence omitted]

SEQ ID NO: 5625 - protein, 333 aa, Neurospora crassa
MQSILQKATGIGPKPVQPTDLNGRVAVVTGGAFGIGFEVSRALANAGCRVIMVNRKEEQGDDAKATITAETPGAVVEWRECDMGNLSQVRSVFSELREQLDRLDFLVLSAGINTNQYGLDADGIDRHFGVNYLGQYYVVNQLYPVLKKTSKLPNTPAPRVVFEASEMHRAAPSAVHFASLDEINNPDLGPTELYGRTKLAMILFAKYGLAEKVIKKNGDNIYAASVHPGAVNTAMQQQWKDAYPGITGKLLTWATLAFGRDVKQGSYSALWALTDPKIEEQNLNGWYFSDPDQPGKETSQASDPVLGQALWDLSERIIKDKLGEDALVDWYSA

SEQ ID NO: 5626 - protein, 287 aa, Tropheryma whipplei str. Twist
MGLDNLKVGLAQMLKGGVIMDVVTPDQAKIAEDAGAVAVMALEKIPSDIRASGGVSRMSDPGLIERVMDSVSIPVMAKVRIGHFAEAQILQSLKVDYIDESEVLSVADSSYHIDKRKFTVPFVCGATNLGEALRRISEGASMIRSKGEAGTGDIAQATKHIRAILSEISALTQAREDELPARARKLGAPIDLVRETARLGRLPVVLFTAGGIATPADSSLVMQLGSDGVFVGSGIFKSEDPKAYAAAIVQATAQYDDADLLARVSRNLGQAMPGVSNLDVRFSNRGV

SEQ ID NO: 5627 - protein, 283 aa, Oryza sativa
MATRRGQLGGRERRPPNHIYAAGAPTPELVSGGVRAEDFSESVYPFLWRKSDGKSVYDGCQSWETSFIVQAYCSTDLVNEFSQTLIKAHEFIKMSQVLENTPDNEAYYRHRSKGSWTLSTADNGWCVSDCTAEALKALLMLSKISPDLAGDAINGERLYDAVDGMLSFMNKDGTFSTYECERTTHWLEVLNPSKTFLNIIVDYPFGTWGICFTYGTFFAIKGLVAAGRTYENSSSIKKACNFILSKQLSTGGWGETYLSSETEESAEAHNNKLIIEYKYYSNQ

SEQ ID NO: 5628 - protein, 558 aa, Bacillus anthracis str. A2012
MKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGIPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 5629 - protein, 313 aa, Oryza sativa
  unsure (1)..(313): unsure at all Xaa locations
MASSDDGVVALYGGGKVSCKPPAATFSVKVGLAQMLRGGVIMDVVTPEQARLAEEAGACAVMALERVPADIRAQGGVARMSDPALIRDIKRAVTIPVMAKARIGHFVEAQILEAIGVDYVDESEVLTPADDAHHINKHNFRVPFVCGCRDXLGEALRRIREGAAMIRTKGEAGTGNVVEAVRHVRSVMGEIRALRNMDDDEVFSYAKRIAAPYDLVMQTKQLGRLPVVQFAAGGVATPADAALMMQLGCDGVFVGSGIFKSGDPARRARAIVQAVTHYSDPEILADVSAGLGDAMXGINLNDQNVERYAARSH

SEQ ID NO: 5630 - protein, 177 aa, Oryza sativa
  unsure (1)..(177): unsure at all Xaa locations
MAPTVMASSGTSVAPFQGLKSTAGLPVSRRSTNSGFGNVSNGGRIKCMQVWPIEGIKKFETLSYLPPLTXVEDLLNQIEYLLRSKWVPCLEFTKVGFVYRENHXRSPGYYDARYWTTXELPMFGCTDATQVLKELEEAKKAYPDAFVRIIGFDNVRQVQLISFIAYKPPSSEDSGAN

SEQ ID NO: 5631 - protein, 641 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPW

SEQ ID NO: 5632 - protein, 325 aa, Hordeum vulgare
MAGTCAHVEFLRAQPAWALALAAVGLLVAARAALRLALWVYAAFLRPGKHLRRRYGPWAVVTGATDGIGRAIAFRLAASGLGLVLVGRNPDKLAAVSQEIRAKYPKTEVRTFVLDFASEGLAAGVEALKDSIRGLDVGVLVNNAGVSYPYARYFHEVDEELMRSLIRVNVEGVTRVTHAVLPGMVDRKRGAIVNIGSGAASVVPSDPLYSVYAATKAYVDQFSRCLYVEYKGKGIDVQCQVPLYVATKMASIRRSSFLVPSADTYARAAIRHIGYEPRCTPYWPHSVLWFLISLLPESLVDSTRLSMCIKIRKKGQAKDAKKKAQ

SEQ ID NO: 5633 - protein, 450 aa, Pseudomonas fluorescens PfO-1
MTGQSCGDFARRVSSLTSLSNSKKRNAKMSDLKTAALEYHANPRPGKLSVELTKATATARDLSLAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAKVENIFMVDRTGVIHAGRDDLNQYKAVFAHPTEKRTLDDAIEGADVFVGLSGPNLLSAEQLKRMAANPIVFACSNPDPEISPELAHATRNDVIMATGRSDYPNQVNNVLGFPFIFRGALDVRAKRINEEMKIAAANALRELAKLPVPQEVCDAYGGISLEFGREYIIPKPMDKRLITVISDAVAKAAIETGVATLPYPKNYPLKSVDDVFNG

SEQ ID NO: 5634 - protein, 165 aa, Avena sativa
VTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCE

SEQ ID NO: 5635 - protein, 489 aa, Vaucheria conifera
MSSKSVQERTRIKSQRYESGVIPYAKMGYWDAAYNVKETDVLALFRITPQPGVDPVEAAAAVAGESSTATWTVVWTDLLTACDLYRAKSYRVDPVPGTTDQYFAYIAYQIELFEEGSLANLTASIIGNVFGFKAVKALRLEDMRIPFAYLKTFQGPATGLIVERERMDKFGHPFLGATVKPKLGLSGKNYGRVVYEGLRGGLDFLKDDENINSQPFMRWRERFLYCMEGVNRAVAATGEVKGSYLNATAGTMEEMYARADYAKSLGTIIVMIDLVVGYTAIQTMAIWARKADMILHLHRAGNSTYARQKNHGINFRVICKWMRMSGIDHIHAGTVVGKLEGDPLMVKGFYNTLLLTKLEIDLPQGLFFEMEWAALRKVVPVASGGIHCGQMHQLLYYLGDDVVLQFGGGTIGHPDGIQAGATANRVALEAMVLARNEGRDYLNEGPQILRDAAKTCGPLKTALDLWKDITFEYTSTDTPDFVEVPTQSN

SEQ ID NO: 5636 - protein, 471 aa, GIBBERELLA ZEAE PH-1
MDFTTFSNIIAGSPRGSDITTSGTNPLNQAPLWPAPVATANDVEDAVHAAKEAFPSWSQMSYKQRTELLDRFADLYLSHASDFCQLLTKECGRSKSTLLHNGYDIHVCPKVIHLDSLVVLTRIAKYELPEEKIEDDEKTVIVTHEPLGVVAAICPWNSIGKIAPALATGNCVILKPSPFTPYSSLKLVELAQQVFPPSVLQVLHGNNDLGPRLVKHSDIQKISFTGSTATGKQILKDGADTMKCITLETAGNNASIVLPDVDLRAIIPQIAGGLWFNAGQVCAATRRLYIHQDIFDEAVAQLQEATAETSKDLVSGVGPIQNQAQYEKLKQALVDARQAGYTLISPGRREPEEGFFVQPTIVVSPPQEADIVQHENFGPIVSCIKFSSVDEAVSMANSSNSGLAASVWSSDISTARQVASSLEAGNVYINGPPRPDPHVPFGGHKQSGLGVEYGLQGLLSYCQTKSTYLYK

SEQ ID NO: 5637 - protein, 222 aa, Brassica rapa
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIRISQTDQELDCAGHTEVCMLWKLKTNYIN

SEQ ID NO: 5638 - protein, 427 aa, Sirodotia huillensis
IEASAAIAGESSTATWTVVWTDLLTACDLYRAKAYKVDAVPNTADQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSMEGVNRAQAATGEIKGHYLNVTAGTMEDMYERAEFAKELGSIICMIDLVIGYTAIQTMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 5639 - protein, 647 aa, Magnetospirillum magnetotacticum
MAEPSSVETSVIIRCFNEQKYLPGLFDALDRQSYRDFEVIIVDSGSFDRTREIAEARADQVLRISSHDFTFGYSLNAGIREARGRFIAIASAHTEPCDEHWLANLVEPLRDDTVAMSYGRQLGKACSKFSEAEDFDRTFGPHGREESPARWCVNNANSAIRKDLWEQYGFDEELTGLEDIGWARHWMDKGFRVVYRPDARLYHLHEESWRQIRRRYYREAVAARRMGIKGPNTVLGETWAELRNTASDLINAFNPKDNPVAARLTLGQRLREVVYFRVNRNIGTFKGLLEAHPLETRQEQEDALFDRSTRAVVIHGPGKVALEEMEMPECKPGDVVIATAHVGVCATDLEILSGALGYYKNGMAKYPIVPGHEFSGHVVSMGQNVTAFKEGDPVVVECIQSCGSCAECRAGNFIGCAERTELGVFRRNGAYADFVTVPARFVHKLAAGTDMAQAALCEPLAVVLKGMRRLMPALAAAPGGAKRAAVTGAGCIGHICAVELARRGFPVTIFDRNQSRLDVFKGRDSIETSTDLDRLGEFNVVVEATGHPEVLDKALHAAPAGATLLLLGLPYARKEFSFEAIAAYDKTVVGSVGSTAEDFEEAIRLMPSLDLSPLLACHLPLERFAEGWELARGGSRLKIILDVGDHP

SEQ ID NO: 5640 - protein, 477 aa, Botryocladia uvarioides
KSKRYESGVIPYAKMGYWDPDYVVKDTDVLALFRVTPQPGVDPIEASAAVAGESSTATWTVVWTDLLTACDLYRAKAYRVDAVPNSSEQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIASTGEVKGHYMNVTAATMEDMYERAEFAKQLGTVIIMIDLVIGYTAIQTMGIWARKNDMILHLHRAGNSTYSRQKSHGMNFRVICKWMRMAGVDHIHAGTVVGKLEGDPLMIKGFYNTLLLTHLPVNLPQGIFFEQDWASLRKVTPVASGGIHCGQMHQLLDYLGNDVVLQFGGGTIGHPDGIQAGATANRVALETMVVARNEGRDYVTEGPQILQDAAKTCGPLQTALDLWKDITFNYTSTDTADFVETPTANV

SEQ ID NO: 5641 - protein, 116 aa, Zea mays
MAFENTSTNVAAAQMRNALTNLAETVEDPKEKKLFETEMDNFFALFRRYLNDKAKGNAVDWDRIAPPAQGQVVDYEDLANTESVQFLSKLAVLKLNGGLGTSMGCVGPKSVIEVRD

SEQ ID NO: 5642 - protein, 203 aa, Glycine max; identical to SEQ ID NO: 2850

SEQ ID NO: 5643 - protein, 137 aa, Yersinia pestis CO92
MAKELNPTENIEKLSDIQRYVTQERGTEAPFTGKLLHNKRDGVYQCLCCHQPLFISESKFDSGCGWPSFYQPIDADSIRYIDDYSHNMHRIEIRCGNCDAHLGHVFPDGPQPTGERYCINSASLNFVDDQNGEQTAG

SEQ ID NO: 5644 - protein, 278 aa, Triticum aestivum
  unsure (1)..(278): unsure at all Xaa locations
MAFCSPHTTASLRSPCTTIPNSGFRQNQVILFTTRCSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAKRGHSLEXIKASIEPGNRFDAFLTREHSLSWIEVCTHCSETTRKSAGNDMKKLSLNHSSHEVT

SEQ ID NO: 5645 - protein, 293 aa, Oryza sativa (japonica cultivar-group)
MAPARAHHLLACLLASALLAAATPVTGGGLMTDQLEVLFGQTQLLNDSNGDQTIALTLDREMGSAFKSKTSYLFARIDMDIKLVADDSAGTVTTIYLISEKDWNTHDEIDLEFLGNVTGQPYTLHTNIFANGEGGREVQYRLWFDPTQDFHTYSVIWNPDEILILVDNMPIRQFKNHLDSGVPFPIYQPMRLFGCLWDADDWATEGGRIKTDWSQAPFVAYFRNYTADGCVPSSYAWVCGQGPASSSDWFDRGLDDVKQQQQLREAQDKYMIYNYCNDPERFPDGYPKECGLQ

SEQ ID NO: 5646 - protein, 502 aa, Streptomyces avermitilis MA-4680
MSARRTRVQLDDDAALRAHGYHPELARRMGGFGNFAISFSVICILAGGMTLFGYGLNTGGPAVMMWGWVGIGFMTLLLGMCLAEVTSAYPTSGGLYYMAHRLGGPRWAWVTGWLNLLGLLGAIAGIDYGCALFIGAFASLQWDLVPTPETTILIFAGILLLHGTLNALGVRLVNVLNSISVWWQISGVLLIGGTLTLAPAEHQSAGFVFGHFHNATGFTSPVYVAALGCLLAAYTFCGYDASSHLSEETSQAQVSAPKGIVRSIGYSWIAGFILLAGMLFAVQDYTGTQGSSTGVPPAQIFIDVLGTGVAKGLLMVVIVAQLFCGNAETAAASRMVFAFSRDGALPFSSTWRRVTHRTRTPIAAVWLSVGVALVLALPSLYSPAAYAAVTAINVIGITPAYVIPVYLRLRAGDRFQAGPWNLGGWSKPLGWISVTYVAVLTVVFCLPQASPVTAQSFNYAGLALAVVLLLAWAMWITKGKRHYKIPPLGSAAENTALAGEVM

SEQ ID NO: 5647 - protein, 433 aa, Oceanobacillus iheyensis HTE831
MVRKQGNMKWWQLSLVGIGCTIGTGYFLGSSIAIEQSGAAVLWLFLFAAIGTYFVYESLAKLSIEYPDKGSFRTYAKKAFGDWAGFSNGWVYCLSELLIMGSQLIALGIFTRFWFPNLPLWLCMVIFAVLGLAIILTGLAGFEKMENIFGIMKASAIIMFILVAVLLLVKGTESLINPIPHIFSGDLPSIWWGGFIYAFYAFGGIEIMGLVATDLKNKQEALKAGRWMLLGLGSIYIIALGLALAFIDETKIIADESPFITALQPFDIPLIADVFNGVFIIAGFSTMVASLYAIITILVSLSEDHHAPAFLSKKGRLKIPFPAFVCLIVGLFVSIFIALLLPDRIFEYITTAAGLMLLYNWLFILASFMKLQRPTRWNFMKPIIAGVLIIIAVATTLFAEISRIGFFVSIGFIIMIAIAVLMMKEKWHITSSS

SEQ ID NO: 5648 - protein, 294 aa, Serratia odorifera
IVFRAAQERSDIEIVAINDLLDAEYMAYMLKYDSTHGRFNGSVEVKDGHLVVNGQTIRVTAEKDPANLKWNEVGVDVVAEATGIFLTDETARKHIAAGAKKVVLTGPSKDDTPMFVMGVNLKSYAGQEIVSNASCTTNCLAPLAKVINDKFGIVEALMTTVHATTATQKTVDGPFHKDWRGGRGASQNIIPSSTGAAKAVGKVIPELNGKLTGMAFRVPTPNVSVVDLTARLEKPASYKEVCAAIKEAAEGELKGVLGYTEDDVVSTDFNGEKLTSVFDAKAGIALNDNFVKLV

SEQ ID NO: 5649 - protein, 420 aa, Haemophilus influenzae Rd
MEIISQYGSWLVWITAVFGFFMAFGIGANDVSNSMGTSVGSGTITAKQAIIIALIFESAGAYLAGGEVTQTIKSGVIEPIQFVDTPDILALGMLSTLFASGAWLFIATKMGWPVSGTHTIIGAIIGFACITIGPSSVDWSKIGSIVGSWFVTPVIAGILAYAIFASTQKLIFDTEQPLKNAQKYGPYYMGITVFVLCIVTMKKGLKHVGLNLSNSETLIISLAISLIGMFFFHFYFKSKIFTQSANKGTFGAVEKVFSILMLLTACAMAFAHGSNDVANAIGPLSAVVSIVNEGGKIVSGGALTWWILPLGALGIAVGLITMGQKVMATVGSGITDLTPSRGFAAQFATAMTVVVASGTGLPISTTQTLVGAILGIGFARGIAALNLTVIRNIISSWIVTLPAGAFFAIIIFYVLRTIFN

SEQ ID NO: 5650 - protein, 251 aa, Geobacter metallireducens
  unsure (1)..(251): unsure at all Xaa locations
NISNQQEGSMALRVAINGFGRIGRSVLRAAIKEKGIEFVAINDLTDAKTLAHLLKYDSVHGPFPGKVEAGNGEIIVNGKPIKILAVRNPEELPWKKEKIDVVLESTGLFTSREKAELHLKAGAKKIIISAPATNEDITIVMGVNSNLYDPKKHNIISNASCTTNCLAPVAKVLHETFGIEKGLVTTVHSYTNDQQILDLPHKDLRRARAAAMSMIPTSTGAAXXXXXXXXXXXXXXXXXLTYQTNRRVQWL

SEQ ID NO: 5651 - protein, 362 aa, Streptomyces avermitilis MA-4680
MTTPTIELKPSASPLSDAEREAILASPGFGRHFTDHMVTIKWTEGRGWHDGQLVPYAPLSLDPATMVLHYAQEIFEGLKAYRQPDGSVASFRPDMNAKRFQASARRLGMPELPVETFIEACDVLVQQDASWVPAHGGEESLYLRPFMIATEVGLGVKPANEYLFLVIASPAGAYFPGGVKPVSIWLSEDRVRAVPGGMGDAKTGGNYAASLLAQAEAAEKGCAQVAYLDAVEHKWVEELGGMNLYFVYGNKIITPALTGSLLAGVTRDSLLSVARDLGYESEEGRVSIDQWQADTENGTLTEVFACGTAAVITPVGTVKRSSAEWQHSGGEPGEVTLKLREALLDIQRGIGEDKHGWMHPLG

SEQ ID NO: 5652 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVFDCPNSKLMEQKKFMKAALTTEAFRSYVPIIQNEVESFIKKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 5653 - protein, 499 aa, Schizosaccharomyces pombe
MLHRRIHFKSQSTLDFDSVAVSISASTMKNELDKLVLNSRVSDKKTFGIQMDNFFALYRRYLLHTVKGYECDWDSIRPLGPEDMIDYGDLPLCKNAGKYLNRLAVVKLNGGMGNALGVNYPKAMIEVRDNQSFLDLSIRQIEYLNRRYDVSVPFILMNSYDTNDETCKVLRKYAGCKIDISTFEQSRYPRVFVDSQLPVPKAAPSPIEEWYPPGHGDIFDALVHSGTIERLLAQGKDYLFVSNIDNLGASVDLNILSHVIDNQIEYSMEITDKTKADIKVGILVNQDGLLRLLETNQVPEQHREEFMSDKVFKYINTNNVWLYLPAVKRVVENRELNLDIMPNIETVYYNNEPARIIEFTTAIGSAISQFKKTEGIRVSRPRFISVKNSSDLFLVRCDLYNVDHGSLKIEESRLGFPPPVVRMSNEFKDIAELFCRIPYMPSMKDLVSLSISGNVYFGRNVILKGNIVIVASENTILCIPSNAVLENCVVTGNCKIMEC

SEQ ID NO: 5654 - protein, 120 aa, Zea mays
MQAVGIRRGLTIDPAGEEEAPAARVWRLVRESPVVIFARRGCCMAHVMRRLLAAVGAHATVIELDAGAAEEQELAAAVEGGGVPALFVGGDPVGGLEGLMGLHLSGRLVPRLRELGALCA

SEQ ID NO: 5655 - protein, 122 aa, Zea mays
  unsure (1)..(122): unsure at all Xaa locations
TNGDYLLPFKTGAFLAGAPVQPVILKYPYRRFSPAWDSMDGARHVLLLLCQFINHMEVVRLPVYYPSQLEKEDPKLYANNVRKLIAXRGNLVLSNIGLAEKRVYHAALTGSSLPGARHEKDD

SEQ ID NO: 5656 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEAXXXXXXXXIEYAIANDRDSVTLVXKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 5657 - protein, 340 aa, Zea mays
MRQALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 5658 - protein, 341 aa, Glycine max
  unsure (1)..(341): unsure at all Xaa locations
MAHFTSSGKSDDLTKEDCKGQSALVVCFGEILIDFVPTVGGVSLAEAPAFKKAPGGAPANVAVGISRLGGSSAFVGKVGADEFGYMLADILKKNDVETSGMKFDPNARTALAFVTLRADGEREFLFFRXPSADMLLQESELDENLIKKAKIFHYGSITLIDEPCKSAHLAAMRFAKESGCILSYDPNLRLALWPSAEAARDGIMSIWDQADIIKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALYFANVCGAITVTERGAILALPTKEAVFQFAAT

SEQ ID NO: 5659 - protein, 446 aa, Lactobacillus rhamnosus
MARKAITADEIRQTVKDENVLFLRLMFTDINGIIKNVEVPISQLEKVLNNKIAFDGSSIDGFVRIEESDMLLYPDLNTWLLFPWENDHGKIARLICSVHRPDGTPFGGDPRNNLIRVVNEMKDAGFTAFNIGPEPEFFLFKLDEDGNPTTHLNDRGSYFDFAPLDMGENCRRDIVLELEKMGFEVEASHHEVAPGQHEIDFKYADALEAADNIQTFKLVVKTIARKHGLYATFMPKPLHGINGSGMHINMSLFHDKGNAFFDPDTGDQLSETAMHFLAGVLRHAYALTAINNPTVNSYKRLVPGFEAPVYVAWSGKNRSPLIRVPQSRGLSTRLELRSVDPTANPYLAIAAILQAGLDGVKNQLKPEEAVDRNIYRMQDDERKANHIQDLPSTLHNALKALAADDVVKAALGKHLYQSFMDSKNLEWSAYRQQVSEWERQQYLELY

SEQ ID NO: 5660 - protein, 468 aa, Halosiphon tomentosus
IPYAKMGYWDADYNVKHTDILALIRITPQPGVDPIEAAAAVAGESSTATWTVVWTDLLTACDIYRAKAYRVDPVPGTSDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLSGGLDFLKDDENINSQPFMRWKERFLYCMEGVNRAAAATGEVKGSYLNVTAATMEQMYERAEYSRAVGSVICMIDLVVGYTAIQTMAIWARQAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPQILRSAASTCGPLKAALDLWKDITFDYTSTDTPDFVEVATESN

SEQ ID NO: 5661 - protein, 474 aa, Bacillus anthracis str. Ames
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 5662 - protein, 276 aa, Triticum aestivum
  unsure (1)..(276): unsure at all Xaa locations
MSTALAPGMARGHGFRGAGKGKQRPDSEEPETNRGGGPNGFYVXEEEEGEEVGREELRELEEALSDASSIGAASSDSSSIGEAHQQNAGCEXGNVGESEASAPVDEVLAMGLGTLESLEDALPSKRGLSNFYAGKSKSFTSLAEAAAKAAAKEIAKPENPFNKRRRVLAAWSRRRASCSSLVTTYLPPLLSLDHTVVEGDEEEEEERSDDGDDEDNGSGNGRREKAPASPRFPPRSLHSASQKASVMSRNTINPNTSSFRSPRSFSLSDLQNAGYN

SEQ ID NO: 5663 - protein, 243 aa, Glycine max
MGRGRVELKRIENKINRQVTFAKRRNGLLKKAYELSVLCDAEVALIIFSNRGKQYEFCSGSSMLKTLERYQKCNYGAPEDNVATKEALVLELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 5664 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 5665 - protein, 365 aa, Azotobacter vinelandii
MSPTAPLSLRRSSGMNTFGYAAYSTDSPLAPYTFERRELRPDDVALEILYCGVCHSDLHTARNDWGMSYYPIVPGHEIVGRVIETGTQVTGFKAGDYVAVGCMVDSCRECDQCRKGDEQLCRQGPIYTYSGHDRISGEPTQGGYAKHLVVSEAFCLHMPEGLDLAKAAPLLCAGITTYSPLRTWNVGSGSRVGVIGLGGLGHMAVKLAVGLGAEVTVLSRSADKRADALALGAARLLVSADEGAMAEAAGSFDLIIDTVPAKHDLDPYLPLLDVDGTLVIVGQLGPMSDFSTVPLLSGRRRVAGSPIGGIRETQELLDFCAKKNILPDCEMIRMDQINEAFERMEKADVRYRFVIDMASLSAAAA

SEQ ID NO: 5666 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 5667 - protein, 454 aa, Medicago truncatula
MDLIELSKAVENVELVDTLDTDVSFVRILWVDNSGQHRCRAIPRKRFYDVVTKNGVGLAFVSMVMTSFLDGSPAGSGLGSVGEARLTPDLSTKRTIPWSKQDEIVLGDLNLQPGQAWEYCPREALRRVSKILKDEFDLAMNAGFENEFFLLKSAIREGKEEWIQFDSTPYCSSSAFDVASPILREVTSALHSMGIPVEQLHAEAGKGQFELVLGHMVCTKSADNLVYTRETVRAIARKHGLLATFVPKYTLDDLGSGCHVHLSLWQNGRNVFMASDESSKYGISTLGKEFMAGVLHHLPSILSFVAPLPISYDRLQPNTWSGAYMFWGNENREAPLRASTPPGTPNGFASNFEFKSFDGCANPYLGLSAIIAAGIDGLRRHLSLPEPVDTNPDPEKLQRLPKSLSESLEALHKADFLEEFIGDKLLTAIKAIRKAEIDHYSKNKDAYKQLIHRY

SEQ ID NO: 5668 - protein, 335 aa, Oryza sativa
MVAVVMMAMRKRMRGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAVKPVKGDTVLFFSLHIDGVPDPLSLHGSCPVIEGEKWSAPKWIRIRSYEHPPVSKVTEGCSDNSARCAKWAEAGECEKNPVCQVSEAGISDNIGHPIWRPHFGVIVGGDKRETAVSGE

SEQ ID NO: 5669 - protein, 387 aa, Zea mays
MAAGDLEVLTALDTAKTQWYHFTAIVVAGMGFFTDAYDLFCISLVAIVVSASFKARFPAPAYAVDPAGSTPPQADFVWRIILMLGAMPAALTYYWRTKMPETARYTALVAKNAKQAAADMSKVLQVEISAGAAEEDAAAATATEPAPASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDE

SEQ ID NO: 5670 - protein, 517 aa, Zea mays
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 5671 - protein, 575 aa, Zea mays
MASDSTAAVTVDGSALAGRALAAAGTRHMFGVVGIPVTSLASRAAAAGVRFLAFRNEQSAGYAAAAYGFLTGSPGALLTVSGPGCVHGLAGLSHATANAWPLLMISGSCDQADAGRGDFQELDQIAATKPFAKLAVKATTIADIPRLVFQALAAAVSGRPGGCYLDIPSDVLHQTLPESEAAALIAAAAADSAASDPSPSMHKSLDEGIAKAADLLRCAERPLVVIGKGAAYARAEEAIRKLVDTTGIPFLPTPMGKGVVPDSHPLSATAARSLAIGQCDVALVIGARLNWLLHFGEPPKWSKDVKFILVDVSEEEIELRKPHVGIVGDAKRVTELINREIKDNPFCLARSHPWVEAITKKANDNVLKMEAQLAKDVVPFNFMTPLRIIRDAILAEGSPAPVVVSEGANTMDVGRAVLVQNEPRTRLDAGTWGTMGVGLGYCIAAAAAEPERLVVAVEGDSGFGFSAMEVETLVRYQLPVVVIVFNNNGVYGGDRRSPDEITGPYKDDPAPTSFVPAAGYHKMMEAFGGKGYLVETPDELKSALSESFRARKPAVINVIIDPYAGAESGRMQHKN

SEQ ID NO: 5672 - protein, 493 aa, Actinobacillus pleuropneumoniae serovar 1 str. 4074
MKDLNVFDKNYGLLINGKWTQGSGNDLLPSYNPANGEVLAHFVDATDADVDAAVKAAQEAFKSWRKTTVAERAAILNKIADVIDENSELFALQETLDNGKPIRETRAADIPLASDHFRYFASAIRAGEGSLNQINQEELSLVLREPIGVVGQIIPWNFPFLMAAWKIAPALAAGCTVVIHPSSTTSLSLLSFAQKINHLLPKGVLNVITGKGSKSGEYMLHHKGFNKLAFTGSTEIGRHIAISAAELLIPATLELAAKSANIFFDDMPFDKALEGAQKGILFNQGQVCCAGSRIFVQEGIYDKFVAALAEEFKKVKVGLPWEDDTQMGAQVNAGQLNTILKYVKIGEEEGCRIITGGRKVLSDNLACGEFVEPTLIESKDNNSRIAQEEIFGPVATVIKFKTEEDVIRMANDSEYGLGGGVWTKDINRALRVSQAIETGRVWVNCYNILPAGAPFGGYKSSGIGRETHQMMLDAYTQVKNIYISTREEREGMY

SEQ ID NO: 5673 - protein, 109 aa, Zea mays
  unsure (1)..(109): unsure at all Xaa locations
MICSCADIYMPTDSNHTENIQDLDQLNRKLNQIDDEVAIFHHMQAKVHKYIHERDPYFISSDATRSCIHQALXVGNIDYAFTPQXVHHHFQACXTINKVTILTDKFFIQ

SEQ ID NO: 5674 - protein, 802 aa, Ruminococcus flavefaciens
MKKSIFKRYAAAVGLMASVLMFTAVPTTSNAADDQKTGKVGGFDWEMWNQNYTGTVSMNPGAGSFTCSWSGIENFLARMGKNYDDQKKNYKAFGDIVLTYDVEYTPRGNSYMCIYGWTRNPLMEYYIVEGWGDWEPPGNDGVDNFGTTTIDGKTYKIRKSMRYNQPSIEGTKTFPQYWSVRTTSGSRNNTTNYMKDQVSVTKHFDAWSKAGLDMSGTLYEVSLNIEGYRSNGSANVKSISFDGGIDIPDPEPIKPDENGYYLKENFESGEGNWSGRGSAKVKSSSGYDGTKGIFVSGREDTWNGASINLDELTFKAGETYSLGTAVMQDFESSVDFKLTLQYTDADGKENYDEVKTVTAAKGQWVDLSNSSYTIPSGATGLVLYVEVPESKTDFYMDGAYAGVKGTKPLISISSQSVDPPVTEPTNPTNPTGPSVTKWGDANCDGGVDLSDAIFIMQFLANPNKYGLTGTETNHMTNQGKVNGDVCEHGSGLTEDDAVSIQKYLIRAISELPESYLEGHDPSKTTTTTTRITTTTTTTTTTTTSKTTTTTTTTSPAMHGGYRDLGTPMNTSATMISDFRTGKAGDFFASDGWTNGKPFDCWWYKRNAVINDGCLQLSIDQKWTNDKNPDWDPRYSGGEFRTNNFYHYGYYECSMQAMKNDGVVSSFFTYTGPSDDNPWDEIDIEILGKNTTQVQFNYYTNGQGKHEKLYDLGFDSSEAYHTYGFDWQPNYIAWYVDGREVYRATQDIPKTPGKIMMNAWPGLTVDDWLKAFNGRTPLTAHYQWVTYNKNGVQHSSQGQNPWG

SEQ ID NO: 5675 - protein, 219 aa, Zea mays
  unsure (1)..(219): unsure at all Xaa locations
MAAAARPASAHLLLLAPLPSPPRLSHLIHTRRLYALAPARRPAAARARRESSPPSAPSPPAPGDSLDCVGTGSDVECFVDAGAEDAAPLLPALSAGASKDDGKSEGDAAVSASPTGRELLEWASLVSPFFFWGTAMVAMKGVIPRTGPFFVAAIRLLPAGALLVAFAXAARGRKQPSGWEAWLAIAAFGLIDAACFQVHNHGHVDFLLAFAGLSRGGTA

SEQ ID NO: 5676 - protein, 105 aa, Triticum aestivum
  unsure (1)..(105): unsure at all Xaa locations
SGLELSMEKAQHKYVGLPVTCAILICLFALQHYGTHRVGFIFAPIVCIWLLCISMIGLYNIIHWNHHVYXALSPYYMYQFLKKTQKGGWLSLGGILLCVTGSEAM

SEQ ID NO: 5677 - protein, 103 aa, Amaranthus retroflexus
VFAYPGGASMEIHQALTRSNIIRNVLPRHEQGGVFAAEGYARATGRVGVCIATSGPGATNLVSGLADALLDSVPLVAITGQVLRRMIGTDAFQETPIVEVTRS

SEQ ID NO: 5678 - protein, 442 aa, Picea mariana
MKKLFHSDMEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 5679 - protein, 232 aa, Lycopersicon esculentum
DGKDQNTSKKLKGCSGGKAGESGKAASGSGNDGGATRSAESESRVTKDENDENDNHEFSADKNRSFDLMLANGANAQTNPATGNPVAMPAFNLNIGMDLWNAPSGGPGMIKMRSNQSGVSPAPGMGREWIQDERELKRQKRKQSNRESARRSRLRKQAECEELQHKVETLSNENHGLKEELRKVSEECEKLTSENNSIKDELTRLYGARAVSKLESNANAMALQSNVEEAKS

SEQ ID NO: 5680 - protein, 492 aa, GIBBERELLA ZEAE PH-1
MAEITITGAGGRKIQIPTGLFINNRFIPSTTSETLTTENPTTNTPLGQVSAAQPSDVDAAVSSSKEALKTWKTSQPAERRRLLNRLADLIERDARELASIEAIDAGMLFNMSLGFCIVQAVETLRYFAGWADKIDGQSLEFDQGLAYTKREPIGVCAAVVPWNTPLLITAWKLGPALAAGNTLIIKTPELAPLYGQKLAQLVLEAGFPPGVVNIITGLGPVAGQALADHHQVRKISFTGSLAVGRTILVSAAKSNLKRVTLELGGKGPSIIFNDANFENALAFATAGITMHNGQICAAGSRIYVQADVYDRFVSEFAAKTRDAVMGDPLLDDTVKGPVISSTQKNRIMEYITKAKSEGIELLHGSAEPDSKGNFVPNTAFINVSPTATIMREEVFGPVASFAKFKTEEEVISLANDNEYGLAAAVFTNDISRAVRVSDQIEVGIVFVNTWGSISANSPFGGIKQSGFGRENGTDALNDWTQVKCVKINVFNL

SEQ ID NO: 5681 - protein, 583 aa, Xanthomonas campestris pv. campestris str. ATCC 33913
MRCGGSTPARKRGMFHHRCRVAVPHALPRRGRFFSGFCMHSIDVVLAMLLAVAASGYLIRILPFSLPLPLVQIALGAVVSGVFDAGHELEPELFFLLFLPPLLFLDGWRIPKQGLFRDKAAILELALGLVVFTVVGAGLLIHWLIPAMPLAVAFALAAIISPTDPVAVSSIASKVQIPKRLMHILEGESLLNDASGLVCFQFAVAAVLTGTFSVATASLTFLWVALAGLGLGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNLFKAQRRGEAHVSPPWRIVVAVSLAGVRGAITLAGVLTLPLVLEDGSPFPARQLAIFLAASVILVSLLVASVALPRLLRGLELPEEEDEQLKEDLAVKAASQAALEAVEKLRQRLVEDSAHAERYNAAANQVSQRYQRKLGAVDMAETDPEEAGAFEQALRQFRHAALVAERNELFKLARRREISDDLSRRLVRNLDLIESRKRA

SEQ ID NO: 5682 - protein, 709 aa, Oryza sativa
  unsure (1)..(709): unsure at all Xaa locations
MASTTTKNALLLLLLLLLLFPLLHSSLADVAAAAPSSASAAEVDALMELKAALDPSGRLLPSWARGGDPCGRGDYFEGVSCDARGRVAAVSLQGKGLAGAISPAVAMLPGLTGLYLHYNELAGAIPRQLGDLPMLAELYLGVNNLSGTIPVELGRLPALQVLQLGYNQLSGSIPTQLGQLKKLTVLALQSNQLTGAIPASLGDLPELARLDLSSNRLFGSIPSKLAAIPKLATLDLRNNTLSGSVPSGLKKLNEGFHFDNNSELCGAHFDSLKPCANGDEDDNEEGSKMARKPESTNVKPLQAPQTMNVNRDCDNGGCSRSSSSSTTLSSGAILAGTIIIIGGAAACGISVISWRRRQKQKVGGGGTVESLEGRASSSNASSSLINVEYSSGWDTSSEGSQQGLRLSPEWSPSVRYNMEEVECATQYFAGANLLGRSGFAATYRGAMRDGAAVAVKSIGKSSCKAEEADFLRGLRAITSLRHDNLVALRGFCRSRAXRGECFLVYEFMANGSLSRYLDVKDGDVVLDWATRVSIIKGIAKGIEYLHSSKANKAALVHQNICADKILMDHLFVPHLSGAGEHKLLADDVVFSTLKDSAAMGYLAPEYTTTGRFTDRSDVYAFGVVVFQVLTGRKAVSSELRLLGGGGGAEYSGKLDDLVDPRLGGRFSRPEAAKLAGIALLCTSESPAQRPAMAAVCRLTIYCATLPLQG

SEQ ID NO: 5683 - protein, 756 aa, Oryza sativa (japonica cultivar-group)
SGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKGKCRYLTAFFAYGGCNLVLAAAAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHALRFTGHNGFPVVDEPPLTEAPELVGLVTRSHLLVLLNGKMFMKDQLKTSGSFVLQRFGAFDFAKPGSGKGLKIQDLDFTDEEMEMYVDLHPVTNTSPYTVVETMSLAKAAILFRALGLRHLLVVPKTPDRPPIVGILTRHDFVEEHIHGLFPNLNPHKFHSTSMGG

SEQ ID NO: 5684 - protein, 505 aa, Glycine max
MASLSCSANDLAPLFNDTAAANYLCAQFDSISRKLNVTTYAVDNTYLLFSAYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGSIAERTQFVAYLIYSSFLTGFVYPIVSHWFWSSDGWASATRSHGNVLFGSGVIDFAGSGVVHMVGGIAGLWGALIEGPRIGRFDRSGRSVALRGHSASLVVLGTFLLWFGWYGFNPGSFLTIAKGYESGGYYGQWSAIGRTAVTTTLAGSTAALTTLFSKRLLAGHWNVIDVCNGLLGGFAAITSGCAVVEPWAAIVCGFVAAWVLIGLNKLAAKVEYDDPLEAAQLHGGCGAWGVFFTGLFAKKVYVEEIYGVGRPFGALMGGGGRLLAAQVIQILVVCGWVTATMAPLFYGLHKMKLLRISRDDETAGMDLTRHGGFAYAYHDDEDGSSRGVGFMLRRIEPAASTTPSPPAAPQV

SEQ ID NO: 5685 - protein, 152 aa, Zea mays
  unsure (1)..(152): unsure at all Xaa locations
TWLKWSSTNAIVYRPRPHCQTCRDESSSCRAFETVGGAMTEYTSTIXMGRTSTIWLHNTCAGXLVLSEPIILHLVLMVXLKTRXIQLKPDXTDELQCFHHFGTMLRFITKDTTVTAHNTVGECFCKKQAMLDNSMRACNXLCPENNRILNVQ

SEQ ID NO: 5686 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 5687 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTASPGDFYLGYTMYRHVFPTLALGRYKQAIERR

SEQ ID NO: 5688 - protein, 337 aa, Neurospora crassa
MDGRKHPSSFQQLEKLGEGTYATVFKGRNRQTGELVALKEIHLDSEEGTPSTAIREISLMKELKHENIVALHDVIHTENKLMLVFEYMDGDLKKFMDTNGERGALKPHVIKSFMHQLLKGIDFCHKNRVLHRDLKPQNLLINSKGALKLGDFGLARAFGIPVNTFSNEVVTLWYRAPDVLLGSRTYNTSIDIWSAGCIMAEMFTGRPLFPGTTNEDQIVRIFRIMGTPTERTWPGLTSFPEYKPNWQMYATQSLSSILPQIDRDGIDLLQRMLQLRPELRISAHDALQHHWFNDLVHQQHHHQAQQSMMQQPPMMQQQPMMQQHRGYGQPQPNYEGY

SEQ ID NO: 5689 - protein, 314 aa, Serratia sp. SK-3-20-2
  unsure (1)..(314): unsure at all Xaa locations
CIGCHTCSVTCKNVWTSREGMEYAWFNNVESKPGVGYPNAWEDQEKWKGGWIRKINGKLEPRMGAALGVLSKIFANPDVPALDDYYEPFDYDYQTLHTAPQGKHQPIARPRSLITGQRMKKIEKGPNWEEILGGEFEKRAKDKNFDNMQKAMYGQFENTFMMYLPRLCEHCLNLACVATCPSGAIYKRGEDGIVLIDQDKCRGWRMCLTGCPYKKIYFNWKSGKSEKCIFCYPRIESGQPTVCSETCVGRIRYLGVLLYDADRIEEVTSAENEKDLYQSQLDIFLDPHDPTVIAQALKDCVPXSVIEDAKQSTV

SEQ ID NO: 5690 - protein, 292 aa, Zymomonas mobilis
MKPVRKAIFPVAGQGTRFLPATKAMPKEMLPVVDRPLIQYAVDEARAAGIEELIFVTGRGKQAIEDYFDIAYELEASLTAKGKTGMLDLLEGTRVAPGRACFIRQQEPLGLGHAVWCARDLIGDEPFAVLLPDELLWNPKRPSLVQLVETYNQKGGNVVTVMEVPEEHTHRYGIVDPGKTDGEVTEVKGLVEKPEKAPSRLAMTGRYILQPDIMPLLAQDNRGVGGEIQLTDSMAQLIGKQPFHACRFGGIRHDCGDKAGFIQANVALALERPDIGLRLETIYIAKIFNLMD

SEQ ID NO: 5691 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 5692 - protein, 542 aa, Ipomoea tricolor
MAFGLSSLLQNSELFTSDHASVVSMNLFVALLCACIVLGHLLEENRWVNESITALIIGLCTGVVILLLSRGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQIASGHSSMTTSEPSSPKHFAVPLLDNQHDSESDMITGPEVARPTALRMLLRTPTHTVHRYWRKFDDSFMRPVFGGRGFVPFVAGSPAEQSPR

SEQ ID NO: 5693 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 5694 - protein, 224 aa, Glycine max
MDQYQDDYDFEGGNGKSGKGGRDKSKGRRDNSLNVLTRKFIDLIRKSPNQTVDLNNAVKILNVQKRRIYDITNVLEGIQYIEKVLKNKIKWVGKQVTEELDDKINELEELENLQKEESDIDHWINYLQENLGDLTKDEVNNNYSYVTFDDVKSVNTLAREDDQPFLVIRAPKGTVLEVPVVDNETEENFPHRMQLTSQDEEILIYVVSNDQNAAPGGEVTKLNR

SEQ ID NO: 5695 - protein, 447 aa, Zea mays
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIRKEKSSFGFIDYYDRRYAALAILSLNGRQLYGQPIKVNWAYTSTPREDTSGHFNIFVGDLCPEVTDATLFAFFSGYSTCSDARVMWDQKTGRSRGFGFVSFRNQQDAQSAINDLNGKWLGNRQIRCNWATKGANAGEEKQILDTKVDLSNGSSESGKENPNEDGPENNPQFTTVYVGNLPHEATMNDVHLFFHSLGAGSIEEVRVTRDKGFGFVRYSTHEEAALAIQMGNGQLIGGRQIKCSWGSKPTPQGTASLPLPPPALAPFSTGVSATDLLAYQRLALSKMASNHPALMGQHSLKQVAALGIGGGASQSIYDGGFQGINTVTGTTSAQQQQQLMYY

SEQ ID NO: 5696 - protein, 436 aa, Catharanthus roseus
MATRNVVQVPQQNRDAAPAGMKQKNMAGEGKIRRALGDIGNLVTVRGVEGKPLPQVSRPITRSFCAQLLANAQAAAVAENNKKCKAVNVDGAADGGIIPKGARKPAQKKAATIKPKPEAVIEISSDSEQVKKEKKPSKKDAPTLTSTLTARSKAACGLSKKPKDQIIDIDAADADNELAVVEYVEDIYKFYKIAENESRVHNYMDSQPEINDKMRAILIDWLIEVHHKFELNPETLYLTINIVDRYLAVQTTLRKELQLVGMSAMLIASKYEEIWAPEVNDFVCISDRAYSHQQVLVMEKRILGGLEWNLTVPTPYVFLVRFIKASVPDSNMENMVYFFAELGMMNYSVAMMYCSSMIAASAVYAARCTFNKTPSWDDTLKLHTGFSEYQLIDCAKVLVNLHAMAADNKLKVIFRKYSSLERGSVALLPPAKSLLA

SEQ ID NO: 5697 - protein, 333 aa, Neisseria meningitidis MC58
MMSMKQKIFVLYTGGTIGMTQSSEGLRPDTALVSQALSPFSDGLDFEWHVCNPLIDSSSVTLQHWRDWLDIIADKLPSCDGILILHGTDSMAYTANLLALALQGLGKPIVLTGSQWPYAAENSDAPRNLSTAVAAFSLKLKQTVIAFDGKLYPAVGSSKVSTETAAGFDNPHFGTLAEWDETRGWHNLRLPSQDAAAVSDGLKIRYPDPQAKIAVRTLIPGFAVQELADGLGQLPAQALILQSYGHGNTPADEGFIRAVRDFARQGKLLLNISQVRQGKTAAVYAQGNAFRNSGIINGGKCNLETATALMTLAVSQGWGKEDVYKELVRLKLV

SEQ ID NO: 5698 - protein, 726 aa, Magnaporthe grisea
MRLADIVLDLAAIASASRSVASKHVALRARQINRFGKSSSLTTRPTTAAPSTSASASEPAKAQTVTTAPATTDNAARAPIPKAAETAARVQPSSDAGQDAGGAAAVLGRDRPVAPWATRDGLFATAPRTPRRSLFESAPAKLGEVDATTAEGMPEGININIFQTSRGSKILESLKSDADVDNGATKDATRITDTKEGAKASESTRFESLAAEEPKRESELANKPLQSPEASEMRSTTKAYAADPVTFTPPPVSTPKSSPAAENVVQDSAPAASGYQLRESKVPATRLSRIWNYGGLAAGMLGGALTESISRGFGGGTSGTSAMLSPANMERLVSKLSRMRGAALKMGQMLSFQDAKMLPGPIREVLQRVQDRADYMPAWQRDRVLATNLGSEWRDLFETFEEKPIAAASIGQVHRATLKPQEEGSMPVEVAVKIQFPGVADSINSDLDNLAMLLAATKLLPKGLYLDKTIANARMELAWECDYEREAECAQRYRTLLAGDEEAVFAVPRVFPAASGKQVLTMEFMHGIGVTRGIHSFTQEQRDRIGTHILRLCLREITEFRFMRTDPNWTNFLYNAETGRLELLDFGASREYPERFVSLYVRLLYAASKGDRECVRVLSEELGYPTGHESGVMLDAHTQSVLTLAEPFLKSAPELYDFRDQTITERVKSFIPVMIKERLAPPPEETYSLHRKLSGAFLLCARLGSKVRCREMFTKSVKKSGLVPEV

SEQ ID NO: 5699 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 5700 - protein, 511 aa, Triticum aestivum
  unsure (1)..(511): unsure at all Xaa locations
FLHPPLPPRVRPLGGKNWKGVTRCPAVARLTGRGPAGSFAPPRCTCRAPGAARGSAPSSGRVTRAPPGAAPFPRSSSASSAPAGVRPVTWDPDAVAIIHDVQGYAKAPEDAVADVLKAGMDVNCGGYIHTHGVSAYPQGKITGEDIDRALRNLFAIRMRLGLFNGNPKYNRYGNIGADQVCKKEHQDLALQAAQDGIVLLKNDAGALPLSKSRVSSVAVIGPNGNNASLLLGNYFGPPCISVTPFQALQGYVKDATFVQGCNAAVCNVSNIGEAVHAASGADYVVLFMGLDQNQEREEVDRLELGLPGMQESLVNKVADAAKKPVILVLLCGGPVDVTFAKNNPKIGAIVWAGYPGQAGGIAIAQVLFGEHNPGGRLPVTWYPKEFTAVPMTDMRMRADPSTGYPGRTYRFYKGKTVYNFGYGLSYSKYSHRFASKGTKPPSMSGIXEGLKATASAAGTVSYDVDEMGXEACDRLRFPXVVRVXNHGSMDGRYLVLLXLXWSNXMDGWFVS

SEQ ID NO: 5701 - protein, 495 aa, Escherichia coli K12
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 5702 - protein, 337 aa, Cryptococcus curvatus
MATKVGINGFGRIGRIVLRNALEHGDIDVVAINDPFIDLDYMVYMFKYDSTHGRFKGKVETKDGKLVIEGKPISVFGERDPAAIPWGKAGADYVVESTGVFTTIEKASLHLKGGAKKVIISAPSADAPMFVCGVNLEAYKPEYEVISNASCTTNCLAPLAKVIHDNFGIVEGLMTTVHATTATQKTVDGPSHKDWRGGRGAAANIIPSSTGAAKAVGKVIPSLNGKLTGMSFRIPTSDVSVVDLVVRLEKGASYDQIKEVIKKASEGELKGILGYTEDEVVSTDFLGSTESSVFDAKAGIPLNDKFVKLISWYDNEYGYSRRVCDLIAYVAKKDKSA

SEQ ID NO: 5703 - protein, 497 aa, Azotobacter vinelandii
MTTPTRNDWEERARSLIIEGRAFVDGQYLPAADGATFDCLSPIDGRLLAQVASCAAADADLAVAAARRSFESGRWSRLAPAKRKAVMIRLAELLEIHREELALLETLDMGKPIKYSLSIDVPAAARALRWSGEAIDKLYGEVAATPDDELGLVTREPVGVVAAIVPWNFPLLMACWKLGPALASGNSVVLKPSEKSPLTAIRLAQLAFEAGIPPGVLNVLPGYGHSVGRALALHMDVDCLVFTGSTRVAKQLMVYAGESNMKRIWLEAGGKSPNIVFADAPDLAAAAEAAASAIAFNQGEVCTAGSRLLVERSIKEAFLPLVLEALKTWQPGHPLDPATNVGALVDRQQLDTVLGYIEAGLGEGASLLAGGRRILEETGGTYVEPTVFDGVSNAMKIAREEIFGPVLSVIVFDTPEEAVQIANDTSYGLAAAIWTRDLSKAHRTARALRAGSVWINQYDGGDMTAPFGGFKQSGNGRDKSLHAFDKYTELKATWIKL

SEQ ID NO: 5704 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 5705 - protein, 406 aa, Caulobacter crescentus CB15
MSTDFHRIRRLPPYVFEEVNKIKARLRAEGTDIIDFGMGNPDMPTPQHIVDKLIETARDPKAGRYSASKGVPGLRKAMANYYGRRFGVKLNPDTEVIATLGSKEGFANLAQALTGPGDVIICPNPAYPIHAFGFIMAGGIIRHVPALSPEEYLSNISRAVKHSVPPPSVLILSYPSNPTAQWVDLDFYKDAVALAKKHDLLVISDVAYGEIYFDNNPPPSILQVDGAKDIAVEVNSLSKTYAMAGWRVGMVVGNARICAALARVKSYLDYGAYTPVQVAAATALNGPQDCVDEIRGIYKSRRDTLIKSMKAAGWDIPNPPASMFAWAKIPEAYREAGSMLFSRLLIEEAGVAVAPGIGFGEYGEGYVRIGLVENEHRIRQAARNVKKFIANADSILAKAHNKMEQA

SEQ ID NO: 5706 - protein, 326 aa, Archaeoglobus fulgidus DSM 4304
MKKIVVIPGDGIGKEVMEAAMLILEKLDLPFEYSYYDAGDEALEKYGKALPDETLEACRKSDAVLFGAAGETAADVIVRLRRELGTFANVRPAKAIEGIECLYPGLDIVVVRENTECLYMGFEFGFGDVTEAIRVITREASERIARYAFELAKREGRKKVTALHKANVMKKTCGLFRDVCREVAKDYPEIQYNDYYIDAACMYLVMDPFRFDVIVTTNMFGDIVSDLAAGLVGGLGLAPSANVGERTAIFEPVHGAAFDIAGKGIANPTAMILTACMMLRHFGYVEEAKKVEEAVEKTIKEGKKTPDLGGNLKTMEFANEVASLLD

SEQ ID NO: 5707 - protein, 447 aa, Candidatus Blochmannia floridanus
MPEIVNIISREIVDSRGNPTVESEVHTKSGFFGLASVPSGSSLGSQEALELRDNDHARFFGKGVKKSVNIINSTIRVSLLNIDVTKQSVIDEIMINLDGTNNKSQLGANSILSVSLAIAKAAASFMGMPLYQYIARLYGMSSNVYSMPVPMMNIMNGGKHADNNLDIQEFMIVPVGAKNIKQAIQMGSEISYSLKNVLNNLGISIALGDEGGYAPNLKSHSYALELINKSIEQSNYVLGKDVVLAIDCAASELFEVSTGKYVINSEKVSFTSEEFVDYLSSLARKYCIFSIEDGQSEHDWHGFSYLTKKLGDIMQLVGDDLFVTNPNLLKMGINKNVANSILVKPNQIGSLTETLNVIKLAKESGYSTIVSHRSGETEDTSIADIAVGTSAGQIKTGPVRCSERTSKYNRLIRIEEFLKDNSKFYGVNEIKNLSAQLWMYQNKNMNI

SEQ ID NO: 5708 - protein, 203 aa, Clematis integrifolia
KRRNGLLKKAYELSVLCDAEVALIVFSNRGRLYEYANNSVRKTIDRYKKTCSDPQTALTVSEANTMFYQQETTKMKQQIEILQNSNRHLMGEALSCLSIKELKQLESRLEKGLGRIRSKKNEMLLSEIEYMQKREIDLHNDNLYLRAKISDNEKAQHNMNVLPGNVYEAMTSAPYDARNFLQVNLPDTKEHPYCSGSTALQLC

SEQ ID NO: 5709 - protein, 575 aa, Lactococcus lactis subsp. lactis
MKKIKLEKPTSGSQLVLQTLKELGVEIIFGYPGGAMLPLYDAIHNFEGIQHILARHEQGATHEAEGYAKSSGKVGVVVVTSGPGATNAVTGIADAYLDSVPLLVFTGQVGRQSIGKDAFQEADTVGITAPITKYNYQIRETADIPRIVTEAYYLARTGRPGPVEIDLPKDVSTLEVTEINDPSLNLPHYHESEKATDEQLQELLTELSVSKKPVIIAGGGINYSGSVDIFRAFVEKYQIPVVSTLLGLGTLPISHELQLGMAGMHGSYAANMALVEADYIINLGSRFDDRVVSNPAKFAKNAVVAHIDIDAAELGKIVKTDIPILSDLKAALSRLLQLNKVRTDFNDWIKTVIENKEKAPFTYEPQNHDIRPQETIKLIGEYTQGDAIIVTDVGQHQMWVAQYYPYKNARQLITSGGMGTMGFGIPAAIGAKLAQPNKNVIVFVGDGGFQMTNQELALLNGYGIAIKVVLINNHSLGMVRQWQESFYEERRSQSVFDVEPNFQLLAEAYGIKHVKLDNPKTLADDLKIITEDEPMLIEVLISKSEHVLPMIPAGLHNDEMIGLHFTDKNEEIDNA

SEQ ID NO: 5710 - protein, 104 aa, Oryza sativa; identical to SEQ ID NO: 4087

SEQ ID NO: 5711 - protein, 370 aa, Zea mays
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 5712 - protein, 477 aa, Solanum tuberosum
MATAATLSPADAEKLNNLKSAVAGLNQISDNEKSGFINLVGRYLSGEAQHIDWSKIQTPTDEVVVPYDKLAPLSEDPAETKNLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLEGKVTIAAKSGVKLEIPDGAVIANKDINGPEDI

SEQ ID NO: 5713 - protein, 345 aa, Zea mays
QHRGCPPPAKASSARKSASSALASLEYSNAWDPLADARGGLGLFSQDALAQSLRISTGEVESATRYFSELNLLGRRGKKAGGLAGTYRGTLRDGTSVAVKRLGKTCCRQEEADFLSGLRLLAELRHDNVVALRGFCCSRARGECFLVYDFVPNGSLSQFLDVDADNAGGGSGRVLQWSTRISIIKGIAKGIEYLHSTRTNKPALVHQNISADKVLLDYAYRPLISGCGLHKLLVDDLVFSTLKASAAMGYLAPEYTTVGRFSEKSDVYAFGVIVLQVLTGKSKVTTTHAQLPDKDVDELVDGNLQGDNYSAAEAAQLAKIGSACTSENPDQRPTMAELLQELSTI

SEQ ID NO: 5714 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 5715 - protein, 176 aa, Staphylococcus epidermidis ATCC 12228
MHKHQHQNIHLNRPIHVAILTVSDTRDYDSDKGGQLIQSLINQHENHVDINHYRIVKDDIEAITHQLKLWLTSSNQLDVIITTGGTGISQRDVTIEAVRPLLTKELEGFGELFRYLSYTEDVGTRALLTRAIAGTCDSTLIFALPGSTGAIKLAIEKLIKPELSHLVFELNKDIRN

SEQ ID NO: 5716 - protein, 378 aa, Oryza sativa (japonica cultivar-group)
MDASRNSDLAADELLRAQAELWNHIFAYTKSMSLRCAVELGIPDAVHRRGGAVTVPELVAELALPRSREPFLRRLMRLLAHGGIFDAAAGAEDAYGLTAVSRLLVSAPGGAGQGLSPFARAMLHPIIVSPSISLASWFRAAAADDDDEGADAPRVPFAAVHGGRELWAVAKDDPGFGAAFNDAMACDGRFVMDVLLHGHHHGGAQLFRGITSLVDVGGGSGGAARASAAAFPHVRCTVLELPQVVATVPPGDGGVEFVAGDMFDHVPKADAVLLKWILHGWGDEECVRILRRCREAVPAREDGRRVIVMDLVVGSSSSLGDGARDTETQLLWDVMMMGVVGSPERDEREFCKIFHDAGFSGYKILHVLGIRSVIEVYP

SEQ ID NO: 5717 - protein, 395 aa, Neisseria meningitidis Z2491
MNTLLKQLKPYPFARLHEAMQGISAPEGMEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRLYQEKFERVIPILQQVFDVKLPDASFYIWLKVPDGDDLAFARNLWQKAAIQVLPGRFLARDTEQGNPGEGYVRIALVADVATCVKAAEDIVSLYR

SEQ ID NO: 5718 - protein, 423 aa, Streptomyces coelicolor A3(2)
MESFSLILAIVVVTALAFDFTNGFHDTANAMATTISTGALKPKVAVAMSAVLNLVGAFLSVEVANTISKGLVDETGIRPEVIFAALVGAILWNLLTWLVGLPSSSSHALMGGLIGAAVASAGIGAVNGDVLVTKVLLPAIAAPIVAGLAALLASRMTYSLGRRADGRAAAKGYRAGQIASAGLVSLAHGTNDAQKTMGIITLALIAGGSLAPDSDPPVWVILSAGLAIALGTYLGGWRIIRTMGKGLTDLQPQQGFAAQTSAATVILASSHLGFSLSTTHSVSGAVMGAGLGRKGGVVRWSTATRMFVAWGLTLPAAALVAALAEWVCRAGDWGTALVAVFLIASSFAIWRISRREVVDHTNVVDGGPVDTEGPGQPEPAGVVTTAMAAVSPPPTGATEELAATLPAPATTPDPKAPSAATTV

SEQ ID NO: 5719 - protein, 474 aa, Zea mays
MDMALASKASPPPWNATTAEQLIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 5720 - protein, 676 aa, Escherichia coli CFT073
MKLAACFLTLLPGFAVAASWTSPGFPAFSEQGTGTFVSHAQLPKGTRPLMLNFDQQCWQPADAIKLNQMLSLQPCSNTPPQWRLFRDGEYTLQLDTRSGTPTLMISLQNTVEPVASLVRECPKWDGLPLTLDVSATFAEGAAVRDYYSQQIAIVKNGQITLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGSEADLRTLVDSAHQRGIRILFDVVMNHTGYATLADMQEYQFGALYLSGDELKKTLGERWSDWKPAAGQTWHSFNDYINFSDKTGWDKWWGKNWIRTDIGDYDNPGFDDLTMSLAFLPDIKTESTSASGLPVFYKNKTDTHAKDIDGFTPRDYLTHWLSQWVRDYGIDGFRVDTAKHVELPAWQQLKTEASAALREWKKANPDKALDDKPFWMTGEAWGHGVMQSDYYRHDFDAMINFDYQEQAAKAVDCLAQMDTTWQQMAEKLQDFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLSLKQGYGFVREHGDDKVLVIWAGQQ

SEQ ID NO: 5721 - protein, 442 aa, Synechocystis sp. PCC 6803
MKPKNFPLARYVLGAMLAFLFVGVAQAQTETTSIAEVTYAINNLFLLAAAVLVLFMQAGFAMLEAGLSSHKNTVNVLFKNTFDVCVGVLLYFLFGYSLMYGENPVLGGFFGWGGFGITNNLDNVEGLSPQVDWLFQAAFAATAATIVSGAVMGRMYFKAYLIYSAVITGLVYPISGHWKWGGGWLDKLGFHDFAGSLLVHSVGGFAALAAVVVMGPRIGRFEGNKINSLGYQGITSSSLGVFILWVGWYGFNPGSQLAFVGALNTNTTMLIAVNTTLSAAAGGLAALAFDWITENKRKPNLLVTLNGILGGLVGITAGCDTVSNWSAIAIGVVAGILSVLGTKLLDRLRIDDGVGAWPVHGLCGIWGGIAVGIFSTNVEHKLSAQIVGSLVIPFWAFITMFFLFYVMDLWGILRVKPSQEKVGLDIVEHGQTEKGVEIAFED

SEQ ID NO: 5722 - protein, 311 aa, Oryza sativa
MAALSSRRRHGSLRLLAVALLVLAGVASSAAAAGSGRGAFDPSRVVQLSWRPRAFLHKGFLTDAECEHLISLAKDKLEKSMVADNESGKSVMSEVRTSSGMFLEKKQDEVVARIEERIAAWTFLPPDNGESIQILHYQNGEKYEPHYDYFHDKNNQALGGHRIATVLMYLSDVGKGGETIFPEAEVVYRKLLQPKDDTWSDCAKNGYAVKPVKGDALLFFSLHPDATTDSDSLHGSCPVIEGQKWSATKWIHVRSFDISVKQGASTDGCEDENVLCPQWAAVGECAKNPNYMVGTNEAPGFCRKSCNVCAQ

SEQ ID NO: 5723 - protein, 182 aa, Zea mays
VGKNYVCSEWKQELITFSQFLDRMSSTVCPSNLTYLAQHPLFEQIKELSEDIIVPEYCYAGGGELQSLNAWFGPEGTVTPLHHDPHHNILAQVSGKKYIRFYRAVIAGDLYPHTATMLSNTSQVDLDNIDLKEFPTVESLEFIDCILVEGDLLYIPTKWWHYVRSLPTSFSVSFWWRALQGC

SEQ ID NO: 5724 - protein, 344 aa, Nitrobacter winogradskyi
IGCHTCSIACKNIWTDRKGTEYMYWNNVETKPGTGYPTRWEDQTKYRGGWVVDGQRQKNLRLRLQGKWGTLTNIFYNPYLPTLDDYFEPWTYDYQNLITAPLADEQPTARAISMVTGEYMDTIEAGPNWDDDLGGSQVYANNDPNFDGASDEEMRQINEINSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPDSKIEAAQKSPVFQFVKRWGIALPLHPEFRTLPMLFYVP

SEQ ID NO: 5725 - protein, 565 aa, Bacteroides thetaiotaomicron VPI-5482
MSKDLITGAEAMMRSLEHQGVTTIFGYPGGSIMPTFDALYDHQNTLNHILVRHEQGAAHAAQGYARVSGKVGVCLVTSGPGATNTITGIADAMIDSTPIVVIAGQVGTGFLGTDAFQEVDLVGITQPIAKWSYQIRRAEDVAWAIARAFYIASSGRPGPVVLDFAKNAQVEKTKYEPTKQEFIRSYVPVPDTDEESVKAAAELINNAERPLVLVGQGVELGSAQEELRIFIEKADMPAGCTLLGLSALPTDHPLNKGMLGMHGNLGPNINTNKCDVLIAVGMRFDDRVTGNLATYAKQAKVIHFDIDPAEVNKNVKVDIAVLGDCKKTLAAVTGLLKKNRHTEWVDSFKEYEAVEEEKVIRPELHPATDSLSMGEVVRAVSEATRHEAILVTDVGQNQMISARYFKYTRERSIVTSGGLGTMGFGLPAAIGATFGRPDRTVCVFMGDGGLQMNIQELGTIMEQKAPVKIICLNNNYLGNVRQWQAMFFNRRYSFTPMLNPDYMKIASAYDIPSKRVFSREELKAAIDEMLSTDGAFLLEACVVEEGNVLPMTPPGGSVNQMLLEC

SEQ ID NO: 5726 - protein, 304 aa, Novosphingobium aromaticivorans
MCFALITPALMVGAWVDRARFGWVVAFSALWSLIVYAPVAHWVWGGGWLATRFGTLDFAGGIVVHTTAGVSALVVAMLLGKRAGFPRTLMLPHSPSLTMAGAALLWVGWFGFNGGSALAANDDAASAIINTHVAACVAALVWLIIEKLSVGKPTSVGFATGAVAGLATVTPAAGFISPGAAMLFGAAAACVCYPMIQIVKQRLEIDDSLDVFAVHGVGGMIGSLLLAVFLAPSFGGTGYADGMNLARQAVAQFAGVGIVAAWSAFATVICALMVSMVIPMRVTEDEEREGLDITSHGERAWEFD

SEQ ID NO: 5727 - protein, 553 aa, Daucus carota
MNRNSINILNYMQFTDAYLDKYGVLMTLELYSNNISGPIPSDLGNLTNLVSLDLYMNSFSGPIPDTLGKLTRLRFLRLNNNSLSGPIPMSLTNITTLQVLDLSNNRLSGPVPDNGSFSLFTPISFANNLNLCGPVTGRPCPGSPPFSPPPPFIPPSTVQPPGQNGPTGAIAGGVAAGAALLFAAPAMAFAWWRRRKPREHFFDVPAEEDPEVHLGQLKRFSLRELQVATDTFSTILGRGGFGKVYKGRLADGSLVAVKRLKEERTPGGELQFQTEVEMISMAVHRNLLRLRGFCMTPTERLLVYPYMANGSVASCLRERQPSEPPLDWPTRKRIALGSARGLSYLHDHCDPKIIHRDVKAANILLDEEFEAVVGDFGLARLMDYKDTHVTTAVRGTLGYIAPEYLSTGKSSEKTDVFGYGIMLLELITGQRAFDLARLANDDDVMLLDWVKSLLKEKKLEMLVDPDLENNYIDTEVEQLIQVALLCTQGSPMERPKMSEVVRMLEGDGLAEKWDEWQKVEVIHQDVELAPHRTSEWILDSTDNLHAFELSGPR

SEQ ID NO: 5728 - protein, 574 aa, Xanthomonas campestris pv. campestris str. ATCC 33913
MALSPNDPHRTPAQATHPADNAVVGGMSRRTQILRLLLRYRGSGVFAGMSLDPAAVNEYEVPAEGTPDQFVADLEALGPTFVKLGQMLSTRPDIVPPEFATALERMQENTSSVPVERIRQIIEEELGVAVNKAFSHFDPVPLGCASLAQVHRAALRDGTPVAIKVQKPEVAAQVRSDLDVLKSFANAADRLTGIGRRVRFADWLGEFGKTLRAELNYEAEAETLVRFGEHLKPFPLLWVPQPVWDLSSRKVLTMQLAEGVRVDKISGLRRTEQPMDELAAALVKGYLDQMFVHGEIHADPHPGNLRVMPDGRLAIFDLGMVAHVPPRLRERLLKLLFAAVDGRGEEVAEETIALSTRLEDYDEERYLRETGQMIARYAAHDATSEGRVVLDLVRIATATGLRTPPELSLLGKTLLNLEGVCRALSPALDTRRIVERHLQHVMRARLKKSMSAANLASEAMELQHLLREGPRRMSDILSLVAENRMQMRVTGLEESHLMESLQKIANRVAAGIVTAALIMASSQMMRIETGLKLWGYPAIAMVLFLLGVFLGLGIVLSALVFDRRVRAREERGHR

SEQ ID NO: 5729 - protein, 233 aa, Kluyveromyces delphensis
MFRNNYDGDTVTFSPTGRLFQVEYALEAIKQGSVTVGLRSKGYAVLVALKRNADELSSYQRKIIKCDEHLGLSLAGLAPDARVLSNYLRQQCNYSQLVYNRKLSVEKAGHMLCDKAQKNTQSYGGRPYGVGLLIIGYDNSGPHLLEFQPSGNTLELYGSAIGARSQGAKTYLERTMDEFLEIDDADALIKAGVEALRQSLKDETLNTDNLSIAIVGKDVPFTIYDGESVAKYL

SEQ ID NO: 5730 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 5731 - protein, 396 aa, Glycine max
MALSRLSHRSIGSTLTKPFSAAAASAASSRSISTSDTPLTIETSVPFTAHNCDPPSRAVATSSSELLTFFRDMALMRRMEIAADSLYKAKLIRGFCHLYDGQEAVAVGMEAAITKKDSIITAYRDHCIFVGRGGTLLEVFAELMGRKEGCSKGKGGSMHFYKKESGFYGGHGIVGAQVPLGCGLAFAQKYSKDESVTFAMYGDGAANQGQLFEALNIAALWDLPAILVCENNHYGMGTAEWRAAKSPAYYKRGDYVPGLKVDGMDVLAVKQACKFAKEHALKNGPLILEMDTYRYHGHSMSDPGSTYRTRDEISGVRQERDPIERVRKLVLSHDIAAEKELKDIEKEVRKEVDEAIAKAKESPMPDPSDLFTNVYVKGYGVETFGADRKEVRATLP

SEQ ID NO: 5732 - protein, 227 aa, Zea mays
MAGTSSWSSSSSCASSFGSPDHDVVCVTEPDSVGAAGAVADAEGSVKFLCSYGGRILPRRTDGTLRYVGGDNRVLSVDRPIRFYVLQRKLRELCGGWEAHLRCQLPTEDLDALISVTCDDDLAKLLEEYDEASKDRLQSLKIRAFLFPTRTPAPSILQRRSPPSIAHLHWQNTSPPAAAGVSLTCAPRWWAAPQASRQAQAPQAQNYDRHSLGEERPRLYYSYMPRT

SEQ ID NO: 5733 - protein, 367 aa, Buchnera aphidicola (Tetraneura caerulescens)
MIKKFKLAILAGDGIGPEVMEEGIKILEVIKKKFMLKLDIKEYLVGGVAIDKFGTALPKSTIDGCLNADAVLFGSVGGDKWKHLPVEQQPERAALLPLRKILNLFVNIRSSKLYSSLSHLSPLKSKIVNNGFDILCVRELIGGIYYGIPKGQKMDNYKRRYAVDTSIYYEEEITRIANFAFEIATFRRKKVTSVDKANVLETSILWREVVNKVAKKYPEISLNHLYVDNASMQIIKNPMDFDVILCPNLFGDILSDECGMITGSIGMLPSASLNKSKFGLYEPAGGSAPDISGKNIANPIALILSISMLFKYSFEQLNIADAIESSVINVLKDGYRTFDILTTNTNEKLLSTSSMGSKISDYLKHEE

SEQ ID NO: 5734 - protein, 560 aa, Saccharomyces cerevisiae
MTTTATQHFAQLLQKYGIDTVFGIVGIPIVQLADTMVANGIKFIPCRNEQAASYAASAYGYISDKPGVLLIVGGPGLIHALAGIYNSMSNRWPLLVIAGSSSQSDIHKGGFQELDQVSLLSPFLKFTGKLTPDNIDMITQKALNYCIQGTAGVSYIDVPADFIEYEKPLEGNDRTGNELPMILTPNICGPDPSKIKKVVQLILQHKNKNILIVIGKGAVKNSHEIRRLVNTFNLPFLPTPMAKGIVPDSSPLNVSSARSQALKIADIVLVLGARLNWILHFGTSPKWNSESIFIQFDSNPETLGDNNVSPGADLSIWGDIGLSVTALVEELTRQDSCWKYSGVKQEIREKIQLNQTRLLRKEKTRGAQLNYNQVYGTLRPLIDDYRTILVTEGANTMDIARISFPTDAPRRRLDAGTNATMGIGLGYALACKASHPELDVVLIQGDSAFGFSAMEIETAVRCQLALVIVVMNNSGIYHGEKDIEGDLPPTALSKNCRYDLVGKGLGANDFFVNTISELSRCFQQAVQLSRTKRETSVINVIIEPGEQKQIAFAWQNKPRL

SEQ ID NO: 5735 - protein, 245 aa, Nicotiana tabacum
MGRGRVELKRIENKINRQVTFAKRRNGLLKKAYELSVLCDAEVALIIFSSRGKLSEFCSTSSMMQTLEKYQQCSYASLDPMQSASDHTQNNYHEYLRLKARVELLQRSQRNLLGEDLGTLNSGELEHLEHQLDSSLKQIRSRKTQNMLDQLADLQQKEQMLAEANKQLRRKLEESAARVPLRLSWDNGGQTMQHNRQLPPQTEGFFQPLGLNSSPQFGYSPMGGNEVNAAATANNMNGFIPGWML

SEQ ID NO: 5736 - protein, 371 aa, Saccharomyces cerevisiae
MFRSVATRLSACRGLASNAARKSLTIGLIPGDGIGKEVIPAGKQVLENLNSKHGLSFNFIDLYAGFQTFQETGKALPDETVKVLKEQCQGALFGAVQSPTTKVEGYSSPIVALRREMGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAVDANLREGSIKTPDLGGKASTQQVVDDVLSRL

SEQ ID NO: 5737 - protein, 469 aa, Porphyra umbilicalis
VIPYAKMGYWDADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGELKGHYLNVTAATMEDMYERAEFSKVVGSVICMIDLVIGYTAIQSMAIWARKNDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 5738 - protein, 298 aa, Escherichia coli
MNMANLKAVIPVAGLGMHMLPATKAIPKEMLPIVDKPMIQYIVDEIVAAGIKEIVLVTHSSKNAVENHFDTSYELEALLEQRVKRQQLAEVQAICPPGVTIMNVRQAQPLGLGHSILCARPVVGDNPFVVVLPDIILDGGTADPLRYNLAAMVARFNETGRSQVLAKRMPGDLSEYSVIQTKEPMVAEGQVARIVEFIEKPDEPQTLDSDLMAVGRYVLSADIWAELERTQPGAWGRIQLTDAIAELAKKQSVDAMLMTGESYDCGKKMGYMQAFVTYGMRNLKEGTKFRESIKKLLA

SEQ ID NO: 5739 - protein, 310 aa, Staphylococcus simulans
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSDEKAQAHIDAGAKKVLISAPATGDVKTIVYNVNQDTLDSSDVIVSGASCTTNSLAPVAKVLNDSFGLVEGFMTTIHAYTGDQNTQDGPHRKGDKRRARAAAENIVPNSTGAAKAIGKVIPEIDGKLDGGAQRVPVATGSLTELTVVLDKDVTIEEVNEAMKAASNESFGYNEDEIVSSDVVGMTFGSLFDATQTRVMTVSGRQLVKVAAWYDNEMS

SEQ ID NO: 5740 - protein, 260 aa, Oryza sativa
MELDDASRHGFGRMGFGCKHYRRRCRIRAPCCNDVFHCRHCHNESTKDGHELDRHAVESVICLVCDTEQPVAQVCYNCGVCMGEYFCSACKFFDDDVDREHFHCQDCGICRVGGKDNFFHCEKCGSCYSVSLRDKHCCIENSMKNHCPICYEYLFDSLRETSVLRCGHTMHLQCFHEMLKHDKFSCPICSMPIFDMDKFLRALDAEIEANMLHIDYMVKGWIVCNDCRDTTQVYARVAGHKCCHCQSHNTCRVAAPVLPA

SEQ ID NO: 5741 - protein, 66 aa, Triticum aestivum
MPAPAGEEDKNPSSASGKGSIAHMNLKAKGQDGNEGIFRMKRSTDMKKLLNAYCNRQTVDMKATGI

SEQ ID NO: 5742 - protein, 291 aa, Glycine max
MANKYHVRSISLPSRSHPSTIRVEEELSKIKTWEGTFTSTSGSIHTGISLIEDLYICLDDLLNMASTQKVISHHRGEKCVQEVLDGSVRILDICGITRDTMLQIKENVQALHSSLRRRKGDSCVEASVAEYKLFTKKMKKDAIKLITSLKQMDGKFGVSTLLDLDHHFAAVIRVLREVILMNLSLFQFFLSFFTVSSSNSKTSKWLLVTKLMHRGIKPCEDKSENINEFQCVEASLSTLLNEGTINDEKMQVVHERLEALENAIESVENGLESVFRRLIKTRASLLNIISQ

SEQ ID NO: 5743 - protein, 488 aa, Vaucheria aversa
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYIAYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNVLLETKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATQSK

SEQ ID NO: 5744 - protein, 598 aa, Triticum aestivum
AASPAATSAAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPSGGAFKDMIMEGDGRTSY

SEQ ID NO: 5745 - protein, 307 aa, Klebsiella pneumoniae
MNGKIWVLGDAVVDLLPDGEGRLLQCPGGAPANVAVGVARLGGDSGFIGRVGDDPFGRFMRHTLAQEQVDVNYMRLDAAQRTSTVVVDLDSHGERTFTFMVRPSADLFLQPEDLPPFAAGQWLHVCSIALSAEPSRSTTFAALEAIKRAGGYVSFDPNIRSDLWQDPQDLRDCLDRALALADAIKLSEEELAFISGSDDIVSGIARLNARFQPTLLLVTQGKAGVQAALRGQVSHFPARPVVAVDTTGAGDAFVAGLLAGLAAHGIPDNLAALAPDLALAQTCGALATTAKGAMTALPYKDDLQRSL

SEQ ID NO: 5746 - protein, 866 aa, Thermosynechococcus elongatus BP-1
MNNPATPDGYPVHSVSQTNPAAKDEHCDLYIESDRTGMTVQTLKRAFVDNLHYIQGKDAMFATPYDYFMALAYTVRDRLLHRRIKTAQTYFEQDAKVVYYLSAEFLIGRLLLNNLINVGLYEQTKQAMADFGLDLNELMDREPEPGLGNGGLGRLAACFLDSLATLEIPAVGYGIRYEFGIFEQIITNGWQHEVPDNWLRFGNPWEIARPDYNVEVKFGGHTEAYTDAQGHYRVRWIPSTTVFGTPYDTPIPGYGKNTVNTLRLWSARAAQDFNLQVFNAGDYTQAVSEKTFSENISKVLYPNDNTPQGKELRLRQQYFFVSCSLQDIIRLYLRRHTSFDAFPDKVAIQLNDTHPAIGVAELMRLLVDEYQLGWEKAWDITQRTFAYTNHTLLAEALERWSVDLFGQLLPRHLEIIYEINYRFLNEIRLRYPGNTARLARMSLIEESYPKQVRMAHLACVGSHTVNGVAELHTELIKEELLRDFYEMYPHKFQNKTNGITPRRWLLMSNPPLASLITETLKSDRWITHLEDLRGLEPYATDPAFQAKWQQVKQANKERLAEYIWRNNQIEVDPYSLFDIQVKRIHEYKRQHLAVLHIITLYEQIKANPNIDLQPRTFIFGGKAAPGYFMAKMIIKLINSVADMVNHDSDVNGRLKVVFLSNYSVSLGEMVYPAADLSEQISTAGKEASGTGNMKFALNGALTIGTLDGANVEIRQEVGAENFFLFGLTAQEVMSLKAEGYNPHEYYNSNPMLKKVIDSLISDYFNPREPGLFEPIVNSLLNEDQYMLLADYQSYVDCQQRVAQAFRDKSHWTQMSILNVARMGKFSSDRTIAEYCKDIWHVEPVPVSLDTCRPAFRPSRISQASGL

SEQ ID NO: 5747 - protein, 158 aa, Lycopersicon esculentum
MDLRLLGIDNTPLFHTLHHMMEAAGEDSDKSVNAPSRNYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKTIEVKVA

SEQ ID NO: 5748 - protein, 472 aa, Hypnea volubilis
ESGVIPYAKMGYWDPEYVIKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERFLYAMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIKGFYNTLLLPYLEINLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 5749 - protein, 143 aa, Salmonella enterica
FMPKPMFGDNGSGMHCHMSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 5750 - protein, 759 aa, Escherichia coli K12
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSSLKGSANILVMPNMEAARISYNLLRVSSSEGVTVGPVLMGVAKPVHVLTPIASVRRIVNMVALAVVEAQTQPL

SEQ ID NO: 5751 - protein, 140 aa, Thermobifida fusca
MSEQNPPVQRSEEEWRAILDPEAFAVLRLGATEPPWSGEYVSTTAQGVYRCRACGAELFRSEHKFDAQCGWPSFYDPVDSSAVTLHEDLSHGMVRTEVRCARCGSHLGHVFYGEGYPTPTDARYCINSIALTLEAEDTVE

SEQ ID NO: 5752 - protein, 320 aa, Triticum aestivum
  unsure (1)..(320): unsure at all Xaa locations
MAGLSLEHPWAFAFGLLGNIISFTSLLAPIPTFYRIFKSKSTEGFQSVPYVVALFSAMLWIFYXTGSRPVEGLPHQASTLPGCVIETVYIVMYLVYAPRKAKIFTAKIVVLLNVAGFGLILLLTLFAFHGXTRVISLGWICVGFSVCVFVAPLSIIGRVIKTKSVEYMPFSLSLTLTLSAVVWFLXGLLIKDKYVALPNILGFTFGMIQMVLYMFYMNATPGGERSEGGERGAEDVGGGARGGDQRWQERKELWRRGSPGHRRWSKPSRRRRGQQVMALDSARSVGCGVNSRMQACLMHEFVQALIFVQLFWRVTPAGHA

SEQ ID NO: 5753 - protein, 201 aa, Listeria monocytogenes EGD-e
MILLIDNYDSFTFNLEQYLAEFSEVVVKRNDAADLIKIAALADGIVLSPGPGKPSDAGLLEEVVAKFAKEKPLLGICLGHQAIGEVFGGEVKRAAKIRHGKVSTMRQTAGAIFANLPEEMPVMRYHSLIVDKNTLPDVLEVLAIATDDSEVMAMKVKDYPVYGLQFHPESIGTNDGKQMMENFIHIVEGARENGNLTTKSI

SEQ ID NO: 5754 - protein, 389 aa, Escherichia coli
TLQNGKLNVPENPITPYIEGDGIGVDVTPAMLKVVDAAGEKAYKGERKISWMEIYTGEKSTQVYGQDVWLPAETLDLIREYRVAIKGRMTTPDGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 5755 - protein, 352 aa, GIBBERELLA ZEAE PH-1
MSRLYNTGDGTILSGSTNGRLDTTNYGGPIGRLTPETLIESVSEVLDIAQIAIVNFTGGIDGASSANAGSDRFLNISMDAHKRLCSPDSDIVGAIMIHGTNTLADTVFGVDLTLNCSKPFVTTGSMRPNSALSADGSSNFYDAVRTAIHPEARDRGALIAMNNHLVSAFYATKTNGNTVSTFLAPDQGYIAQFMSGQPYFFYSPPLPKARNYLNPFKLSSPLPKVDIFYGYQGFDADLLYSAAKNGAKGIVIMGVGPSALSMAAFEAAEIFTAKALSQSLRSVRISDSQFPAPNWKRCNISSGVLRGEKALIHLQLALGAGYDFKGIQKLFEGEVRKAVYNDATAFFNGTVL

SEQ ID NO: 5756 - protein, 472 aa, Oryza sativa (japonica cultivar-group)
MLSSEPGVLTGRYGPPFSETRKEQKEQRNLAPHALSRRYLSRAGHGVVALWPGPPFDLSLLLHSSSSYSAEERRRRRRRAGERRAREDMGRRKFRLSDMMPNAWFYKLRDMRARGGRGATAMQPPSSSSLMRGSRAAQQQAGTWRLGTSSSSSSLLPHRASYYYTTRDREVPPLPPPPPPRGVDDQFPSLTLSPPLPTRNSRRRHRVGRFGSTEMDGGELVLAPSDDHDGCSHQEPPVADASGSSRCRRDMFIGRDGGRGVEFRRRATTVDGPEEDAAVDVKVITSDADIIIDLGADDDDDTPERVLRPVVTRPARRELDWCEPAEVKHVDLAELMTPRASSASASSEKSISTGKPRRSSVSSRRRLKTRTNSPRLAACRKGKPTARATTTTPTQPPLAHSFAVVKTSSDPRRDFLESMEEMIAENGIRDAGDLEDLLACYLSLNSGEYHDLIVEVFEQVWTGLAAACGVMP

SEQ ID NO: 5757 - protein, 509 aa, Vibrio rumoiensis
MSDDTKKCPVTHMTTDFGAPVVTNRDSLTAGPRGPLLAQDVWLNEKLAGFVREVIPERRMHAKGSGAFGTFTVTHDITKYTRAKIFSEVGKKTEMFARFTTVAGERGAADAERDIRGFALKFYTEEGNWDMVGNNTPVFFIRDPRQFPDLNKAVKRDPRTNLRSATNNWDYWTLLPEALHQVTVVMSDRGIPASYRHMHGFSSHTYSLWNQAGERFWVKMHFRTQQGIKNLTDAEAGELVAQDRESHQRDLYEAIERGEYPKWTMFIQVMPEADAEKYALHPFDLTKVWYKGDYPLIEVGEFELNKNSENFFADVEQVAFSPSNLVPGIGVSPDRMLQARLFNYADAQRYRLGVNYHQIPVNQARCPVHSNHRDGQGRVDGNYGALPHYEPNSFGQWQGQPQFSEPPLKLTGNAAHWSYDKDDHNYFEQPGKLFRLMNDGQKEALFGNTGRAMGDAPEFIKFRHIRNCHAADPAYGAGVAKALGINLEKALASKKDDPMYGNPLVALPA

SEQ ID NO: 5758 - protein, 419 aa, Grateloupia filicina
DTDVLALFRVTPQPGVDPVEASAAVAGESSTATWTVVWTDLLTACDLYRAKAYKVDAVPNSSEQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWAALRKVTPVASGGIHCGQMHQLLDYLGNDVVLQFGGGTIGHPDGIQAGATANRVALEAMVMARNEGIDYVGEGPQILQDAAKTW

SEQ ID NO: 5759 - protein, 804 aa, Oryza sativa (japonica cultivar-group)
MEGQSQHRAPEREGSHNYDIESTDGSGGLWRRNGSSSGALLRYNDSGGGRSGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKERYLTAFFAYGGCNLVLAAAAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHALRFTGHNGFPVVDEPPLTEAPELVGLVTRSHLLVLLNGKMFMKDQLKTSGSFVLQRFGAFDFAKPGSGKGLKIQDLDFTDEEMEMYVDLHPVTNTSPYTVVETMSLAKAAILFRALGLRHLLVVPKTPDRPPIVGILTRHDFVEEHIHGLFPNLNPHKFHSTSMGG

SEQ ID NO: 5760 - protein, 307 aa, Arabidopsis thaliana
MATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 5761 - protein, 436 aa, Cunninghamella elegans [sequence omitted]

SEQ ID NO: 5762 - protein, 384 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERVNWTIFFVAITEKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLYSSPATDVAAVS

SEQ ID NO: 5763 - protein, 272 aa, Oryza sativa (indica cultivar-group)
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 5764 - protein, 175 aa, Oryza sativa
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 5765 - protein, 358 aa, Escherichia coli
SKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKAGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 5766 - protein, 268 aa, Oryza sativa
SGRIGRNFLRCWHGRGNSSPLDVIAINNTGGVKQASHLLKYNSTLGIFDADVKPVGDNAISVDGKVIKVVSDRNPSNLPWGELGINLVIKGTGVFVNRDGAGKHIQAGAKKVLITAPGKGDIPTYVVGVNADQYSPDEPIISNASCTTNCLAPFVKILDQKFGIIKGTMTTTHSYTGDQRVFDGSHRDLRRARAAALNIVPTSTGAAKAVALVLPNLKGKLNGIALRVPTPNVSVVDLVVQVSKKTLAEEVNQAFRDSAANELKASSE

SEQ ID NO: 5767 - protein, 424 aa, Batrachospermum discorum
IEASAAVAGESSTATWTVVWTDLLTACDLYRAKAYKVDAVPNTSDQYFAYISYDIDLFEEGSVANLTASIIGNVFGFKAVKALRLEDMRMPIAYLKTFQGPATGTIVERERMDKFGRPFLGATVKPKLGLSGKNYGRVVYEGLKGGLDFLKDDENINSQPFMRWRERYLFSIEAVNRAQAAAGEIKGHYLNVTAGTMEDMYERAEFAKQLGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTA

SEQ ID NO: 5768 - protein, 528 aa, Halomonas halodenitrificans
MKIRSQVGMVLNLDKCIGCHTCSVTCKNVWTSREGVEYAWFNNVETKPGIGYPKEWENQDKWKGGWMRRRDGKIEPRIGGKWRVLANIFANPDLPEIDDYYEPFTFDYEHLHNAKQGEHQPTARPRSLISGQRMKKIEWGPNWEEILGTEFAKRRKDMNFEKVQADIYGQFENTFMMYLPRLCEHCLNPTCVASCPSGAIYKREEDGIVLIDQDKCRGWRMCISGCPYKKIYYNWKTGKSEKCIFCYPRIEAGQPTVCSETCVGRIRYLGVLLYDADRIEEVASSPDERDLYHRQCEIFLDPNDPEVIAQAKKDGITDNVIKAAQASPVYKMAMDWGLALPLHPEYRTLPMVWYVPPLSPIQSAAEAGKVEFDGVMPKIESLRIPVKYLANMLTAGEEAPVVLALKRLMAMRLYMRGKHVDGQANTEVLEDVGLTEQQVEDMYRYLAIANYEDRFVIPTSHREIATEAFPERGGCGFSFGDGCHGDSSESLFGGRKTTATLVKPVETFDPQAQSEGQRDKTTEEARHG

SEQ ID NO: 5769 - protein, 212 aa, Zea mays
MDEEEHEVYGQEIPEDGDMDGADVDMAASGDDAAKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEGVQEALNLNESELHGRQIKVAPKRTNVPGMKQRPPRGYNPYHGYPYRSYGAPYFPPYGYGRAPRFRRPMRYRPYF

SEQ ID NO: 5770 - protein, 415 aa, Polysiphonia elongata
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMEEMYERAEFGKQIGTVIIMIDLVIGYTAIQTMAIWARKNDMILHLHRAGNSTYSRQKIHGMNFRVICKWMRMAGVDHIHAGTVVGKLEGDPLMIKGFYDTLLEPYLEINLPQGIFFQQDWASLRKVTPVASGGIHCGQMHQLLDYLGNDVVLQFGGGTIGHPDGIQAGATANRVALESMVIARNEGRDYVAEGPQILLDAAKTCGPLQTALDLWKDITF

SEQ ID NO: 5771 - protein, 325 aa, Mallomonas rasilis
SKVGINGFGRIGRLVARIMVNDPRTTLKAINTGADATYMAYQFKYDTVHGQWKGSLEVEGDDLIINGQRIKTVHARDPKEIGWGKLGVEYLCESTGVFLTADSAKPHVDGGVKKVIFSAPAKDKSPTIVMGVNDKDYTSDMTYVSCASCTTNGLAPMVKAIHDNFGIEEALMTTVHAMTSTQMVVDGSSKKDWRGGRAASANIIPSSTGAAKAVTAVIPSLKGKLTGMAFRVPVPDVSVVDLTCRLARDTTYEEICNKVKELSQGEMKGILGYTNEDLVSQDFVSSPISSVFDAKAGIMLNPRFVKLVAWYDNEWGYSKGEFQHT

SEQ ID NO: 5772 - protein, 407 aa, Desulfitobacterium hafniense
MKAMETMISLERALEVILHRIEPLGVEEVGLGQAYNRVLAKDVQAAIDMPPFDRSPLDGYAYCAQPTDKAPLTLDIVSEIPAGTWSEREIRLGECARIFTGSPLPKGANCVVRQEDTERSAGQVTINQPVKPQANIVYQGEETKCGDIVLRAGEYLSPAAVGLLASLGVETVEVYRRPKVGILSTGSELQDVGSPLLPGKIYNSNTYTLKGLLLEAGCEVKAAPFVGDDLEETIEALKALEDTDLVVTTGGASVGDYDLIRDALVGAGCELLFWKVNFKPGTPVALGVKGERLYFSLSGNPAAAVVNYELLVRPALRKLKGRTAQERIFPVYMDGDFGKSGKQRRFLRARAVFRNGEIWADPSFAQGSGVIRSMRGSHLLVDVPGGHGPVQKGERLQGRWISSWEED

SEQ ID NO: 5773 - protein, 401 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVFDGWKAPSIMQVPGARDVAVEFFTLSKSYNMAGWRIGFMVGNKTLVNALARIKSYHDYGTFTPLQVAAIAALEGDQQCVLDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLP

SEQ ID NO: 5774 - protein, 200 aa, Brucella melitensis 16M
MSSSSDAIKAALEKGRAAGLSATGGKNADYIPFLASVPSDLFGLAVVTADGQTFKTGDADIAFAIESISKVFTLALVMEEIGPDSVREKVGADPTGLPFNSVIALELHNGKSLSPLVNAGAIATASLVPGDTADARWNNILECQCGFAGRRLKLSNEVNQSNRRPIFTTAPLPGCFTVPVLATAIRWRPWIFIRANVQRL

SEQ ID NO: 5775 - protein, 273 aa, Zea mays
MSTAVARPAHGGFRRSGSGKPDPDEADRMTRSANGYLVQEEEEEEHGEEAAARREDEDEEEEEEEAEAVSEASSIGAASSDSSSSIGENSASDKEEEEEEVESKAQGLGMMGLATLESLDDALPSKRGLSSFYAGKSKSFTSLAEAAAAAAAREIAKPENPFNKRRRVLQAWSRRRASCSALAAAYLPPLLAPDHAVVEEDDEEGADDEEEEDEDEEHGGGGGGLRGTRKPPTFPSPRLSVHVAAAGQMARNGSFRSPRSFSMTDLHSAAGYE

SEQ ID NO: 5776 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 5777 - protein, 445 aa, Gibberella acuminata
MFTKAFSTAAMALACAGMVSAQTFTDCNPLKKTCPPNPAFGDKKVECDFAKGECDAFHSMIGTNLKYSEQGALFTINKETDAPTIRSNNYLFFGRVDIVMEAAKGQGIVTSVVLQSDDLDEIDFEMVGGDDAQVQTNYFSKGDTTTYDRAIYHPVSAPLSTTHKYSVEWTSTKVDWLIDDVVVRTLNAADATRPGYEMPQTPMQLKLGTWVAGGKNSNEGTREWAGGYTDFKEAPFDAYYRSITIIDYAGKDAPGQAKGAKEYVWSDKSGSFTSIKVKNTLSGNDDEEEKTTSSTVSKVSKTTKTAEPTKTKTHEVTTTSKAEETTSAAETKTKSAEKESKTESAKESKTESVKETKTTEAATTFSTAAASTKAEAAATATEGSGSSSGSGSSADSGADAATATGPATVTDLPNGTTPVPVNSGSRMAGNLVAAVAGLMLAQILI

SEQ ID NO: 5778 - protein, 613 aa, Nostoc sp. PCC 7120
MSDLFKGFEQLIELVKTLEEKAEKGEIKTDFQINSRSMSSIPRTGNIPRPNNMANDIGTSRIRTQPSPNSDSGNGDSSDVVVPPDAPSGNSLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEETVDLDAIAERSVGFVGADLKALCQKAAYTALRRQMPSVESAVPENMTVSQADFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILLVHSQGRPLDGVDFNYWAEMTQDWNGADLTLLCNQAAVEAIRRFRSQGLTDPSEIKITTDDFNYAYKVLTEQRPD

SEQ ID NO: 5779 - protein, 333 aa, Burkholderia fungorum
MTSITLLGETELRALVPLDLAAIDQVEAAFLALATEAVAMPPILRLDLPEHNGEIDVKTAWLPRFDSLAIKVSPGFFGNPSLGLPSLNGLMLVLSARTGLTEAVLLDNGYLTAVRTAAAGAVAARWLAKPHTPRVAVLGAGEQARLQLQALTLVRRIEHVRVWARDAASARRFAQEMSVSLGVQCDAARDVQHALADADVAITATPSRSPLIEAADLHPGLHITAMGSDTEHKNEIAPAALAAARYICDRAQQTRVLGELHHALNAGAVRADAAITELGQVIARQAVGRADEADVTICDLTGTGAQDTAIAALALQRARAAGAGTIFRNDVKR

SEQ ID NO: 5780 - protein, 175 aa, Triticum aestivum
MAPAVMASSATTVAPFQGLKSTAGLPISCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5781 - protein, 182 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLKRVGAEVIECACVIELPELKGRERLEGKPLYVLVEYR

SEQ ID NO: 5782 - protein, 254 aa, Halobacterium sp. NRC-1
MVAYAALVADDWLPRSRTDWTTVGIAAVLMIAAYHAFLFVGEQTTSSAVAAIVVSLSPVLTAGFARAVLPGERLSIGGVVGLGLGLAGVVVLSNPDPSNLVSSTSQGVGLVFAATASFALGSVLTQRIDDALDSEALEAWAMVFGAVVMHVASIAAGEPQTIPWTAEAVFAVAYLSVGASAVGFLIYFRLLDSLGPIEINLVGYVAPVFAAAVGLLWRGEAITTPTIGGFCIVFTGFCVLKRRAIAAELRALSE

SEQ ID NO: 5783 - protein, 549 aa, Yersinia pestis CO92
MEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 5784 - protein, 506 aa, Glycine max
  unsure (1)..(506): unsure at all Xaa locations
KQKVAATKQYIENHYKEQMKNLQERKERRTILEKKLADADVSEEDQNNLLKFLEKKETEYMRLQRHKMGVDDFELLTMIGKGAFGEVRVCREKTSGHVYAMKKLKKSEMLRRGQVEHVKAERNLLAEVDSNCIVKLYLSFXDDEHLYLIMEYLPGGDMMTLLMRKDILTEDEARFYVGETVLAIESIHKHNYIHRDIKPDNLLLDRYGHLKLSDFGLCKPLDCSTLEENDFSVGQNVNGSTQSSTPKRSQQEQLQHWQINRRTLAYSTVGTPDYIAPEVLLKKGYGMECDWWSLGAIMYEMLVGYPPFYSDDPMLTCRKIVNWKTYLKFPEEARLSPEAKDLISKLLCNVNQRLGSKGADEIKAHPFFKGVEWNKLYQMEAAFIPEVNDELDTQNFEKFDESDSQTQSSSRSGPWRKMLSSKKDLNFVGYTYKNFEIVNDYQVPGIAELKKKQSKPKRPTIKSLFEXPEASDTSANDQPAQGSFLKLLPPQLEVSPHRDKNLPPRS

SEQ ID NO: 5785 - protein, 297 aa, Burkholderia mallei
MARKGIILAGGSGTRLYPITHAVSKQLLPVYDKPMIYYPLSTLMVADIRDVLIISTLQDTPRFEAMLGDGSQWGMNIRYAVQPSPDGLAQAFVIGREFVGRDPSTLILGDNIFYGHDLAKQLDRASARQAGATVFAYHVHDPERYGVVEFDGEFRALSIEEKPAKPRSNYAVTGLYFYDNQVCDIAADIKPSARGELEITDVNSRYLAAGLLDVEIMGRGYAWLDTGTHDSLIEAATFIATLQKRQGLVVACPEEIAYRRQWIDAEQLLKLAQPLSKNGYGQYLKNILTDQVAWPSK

SEQ ID NO: 5786 - protein, 144 aa, Larix laricina
VRYRNHEEAALAIQLANGRVICGKSIKCSWGSKPTPPGASSNALPPPSAPFQGVVAAQGLNQGYTAADILAYRQMNMSQAGAGQPLLPLSAQQGMGLGLGHGPMGVVGPAGNQNLYDNFQAGAGLPSAAAAAAAAMRQQIMYYQ

SEQ ID NO: 5787 - protein, 1092 aa, Adiantum capillus-veneris
MSTSSSMNDQRRDAYSLRAPPNEGKLHPLARDSRGSLEVFNPGNPSSLTAASIGAGMQYTPSWQQQQPPEDENYDLPLNQREKEENIYNQTHGGPERERGPDKGTSPSDHKRGMSTGTSPPTRSKYSEIFTSHDTIDKEGKFQAYQTNEESTHDWLSSTPAGQGPMLGGGFGGGEGARGSYLLGTREHPKARCDSLAERAAGWGLVLKTDGDSGRVDGVRTRTSEEEREFRRLSEERRSLNSSTVRTSDDSGFTSDTSNASRIPRVSKDVLQALEGFQQTFVIADGTKPDLPIMYASAGFFKMTGYTSSEVIGRNCRFLQGKETDPEEIDRIRECISKGSGYCGRLLNYKKDGSAFWNLLTISPIKDVDGSVLKYIGMQVEVSQFTEGTKENAMRPNGLSESLIKYDARQKERASFQVTELVEAIKDPKQVGDDKKTSISLGVVRPVAPSGPRKGPDLRELLTAQQYTPRSATSVQPKGSNLTEPGSHRESISKRNRSSGFFSFLGLDKLAGKGPGNQHDAAEFIEPEILMTKDEDSSEASFELDKARLKEIRRGIDLATTLERIEKNFVITDPRLPDNPIIFASDNFLELTEYSREEILGRNCRFLQGPDTNRETVKLIRDAIDNEKEVTVQLLNYTKTGRTFWNLFHLQPMRDHKGELQYFTGVQLDGTEYLEPLTKRLSQQIASEGAKIIRETAANVNEALRELPDANLKVEDLWRIHSRLVLPKPHKLNHDSWGVIRKIHASGEKVKLKHFRPLRPLGYGDTGSVHLVELRGTGKLFAMKAMEKNVMVKRNKVHRVCAEREILGMMDHPFLPTLYASFETQTHVCLITDFCAGGELFLLLERQPTKIFREETARFYTSEVVVALEYLHCQGVIYRDLKPENILLQQDGHVMLSDFDLSYLSSSNPRLVVPPRLHKKRSKRKNFPPPIFRAEPIGACNSFVGTEEYIAPEVITGSGHNSSVDWWALGILMYEMLYGRTPFRGKTRQKTFGNILHKDLVFPRRIPTSLAARQLINGLLQKDPENRLGSQGGANEIKGHPFFQGVNWTLIRCMRPPTFDAPVCFAGSELDVEGDEALDWDDVEASNPIEYF

SEQ ID NO: 5788 - protein, 138 aa, Oryza glaberrima
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 5789 - protein, 294 aa, Daucus carota
MDQYEKVEKIGEGTYGVVYKARDRVTNETIALKKIRLEQEDEGVPSTAIREISLLKEMQHENIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQQPLFPGDSEIDELFKIFRIVGTPNEDTWPGVTALPDFKSAFPKWPSKELGNVVPNLDVAGLNLLKKMLCLDPSRRITARSALEHEYFKDIGIVP

SEQ ID NO: 5790 - protein, 255 aa, Escherichia coli O157:H7 EDL933
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 5791 - protein, 368 aa, Glycine max
LIASVFFLPPKSHTFHCIIIHKWLIPPSSSGQSHDLKKEDCKETRSLVVCFGEMLIDFVPTVGGVSLAEAPAFKKAPGGAPANVAVGISRLGGSSAFIGKVGADEFGYMLGDILKQNNVETSGMRFDSNARTALAFVTLRADGEREFLFFRNPSADMLLQESELDKDLLKQARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 5792 - protein, 431 aa, Prochlorococcus marinus subsp. marinus str. CCMP1375
MKRVLAIILGGGKGSRLYPLTKMRAKPAVPLAGKYRLIDIPISNCINSNITKMYVLTQFNSASLNRHLAQTYNLSSPFAQGFVEVLAAQQTPESPSWFEGTADAVRKYQWLFQEWDVDEYLILSGDQLYRMDYSLFVEHHRETGADLTVAALPVDGAQAEGFGLMRTDNDGNIREFKEKPSGEALKAMAVDTSRFGLSPDSAKERPYLASMGIYVFSRSTLFDLLNKYPSYKDFGKEVIPEALSRGDALKSYVFDAYWEDIGTIGAFYESNLALTQQPTPPFSFYDEKFPIYTRARYLPPSKLVDAQITDSIVGEGSILKSCSIHHCVLGVRSRIESDVVLEDSLVMGSDFYESAEERIALRKGGGIPLGVGQGTTVKRAILDKNTRIGENVTIINKDRIEEADRADQGFYIRNGIVVVVKNASILDGTII

SEQ ID NO: 5793 - protein, 242 aa, Symbiodinium sp. P083-2
LKYMVYQLKYDSVHKTFNGTVACKEDGGKEYLVVNGKDIQVFHEKEPKEIKWGESGAAYVCESTGIFTTKEKAELHLQGGAKKVIISAPPKDDVPMYVVGVNHTEYKSTDTVVSNASRTTNCLAPLTKVVHEKFGIIEGLMTTVHAMTATQLTVDGPSRGGKDWRGGRCASQNIIPSATGAAKAVGKVIPAMNKKLTGMAFRVPTPNVSVVDLTVRLEKPAKYEEIVAAIKDAANGPMKGVL

SEQ ID NO: 5794 - protein, 323 aa, Caulobacter crescentus CB15
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 5795 - protein, 494 aa, Triticum aestivum
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVTRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGRREKTRIKKENDFVQPGERYRSWAPDRQDRFVRRFADALAHPKVSHELRVIWIDFLSKCDKSCGMKVANRLNVKPSM

SEQ ID NO: 5796 - protein, 256 aa, Vibrio parahaemolyticus RIMD 2210633
MRRPVVMGNWKLNGSKAMVTELLTGLNAELEGVEGVDVAVAPPALYIDLAERLIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAAAKA

SEQ ID NO: 5797 - protein, 175 aa, Triticum aestivum
MAPAVMASSATTVAPFQGLKSTTGLPISRPSGSAGLSNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5798 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKAVYVKFHWKTTCGEKCLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRIFSYADTQRHRLGPNYLQLPANSPKCAHHNNHHDGFMNFMHRDEEVNYFPSRYDPVRHAERVPVPPRTLGGKREKCMIEKENNFKQPGERYRSWPSDRQERFVRRWVDALSDPRVTHEIRSIWISYWSQADRSLGQKIASHLNLKPSI

SEQ ID NO: 5799 - protein, 355 aa, Vitis labrusca x Vitis vinifera
MVTSVAPRVESLSSSGIQSIPKEYIRPQEELTSIGNVFEEEKKDEGPQVPTIDLKDIESEDEVVRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPETVSETEPPLFPPRTFSQHIQHKLFRKTQEALLSK

SEQ ID NO: 5800 - protein, 348 aa, Kluyveromyces wickerhamii
MSIPKTQKAVVFYKHGGALEYKEIPVPTPKANEILINVKYSGVCHTDLHAWQGDWPLDTKLPLVGGHEGAGVVVALGANVKGWKIGDFAGIKWLNGSCMACEYCELSNEPNCPEADLSGYTHDGSFQEYATADAVQAARIPAGTDLAAVAPILCAGVTVYKALKSAHLKAGDWVAISGACGGLGSLAIQYANAMGYRVIGIDAGEEKAALFKELGGEYFVDFIKSKDVIKEINDVTKGGAHGVINVSVSENAIEDSTKYVRSNGTVVLVGLPKGAQAKSDVFSQVVKSISIVGSYVGNRADTREALDFFSRGLVHAPIKIVGLSELASIYDKMSKSQVVGRYVVDTSK

SEQ ID NO: 5801 - protein, 376 aa, Oryza sativa (japonica cultivar-group)
MATVSGTDRLRDLHAFDDTKAGVKGLVDAGVTTVPYFFRHHPDPLPVAAPSEAASAIPLIDLAKADVDRGRVVAEVRTAAETVGFFQVVNHGVAGELMDEMLAAVRRFNEEPLEAKVPYYTRDVASKVRFNSNFDLFRSPAANWRDTMFVEMFPEVPSPEEIPPPCRGVLEEYAAAVRRLGERLFELLSEALGLPAGYLGRDAGGTDGLSVAAHYYPACPEPEATMGATKHSDPTFLTVLLQDESGGLQAVLPRPPEERWVDVPPVAGALVVNVGDLLQLVSNERLRSVEHRVLPTGAAGPARVSVACFFRLAYSSTRPCVPVVGGGSGARAAAVYRSTTAGEFLAHYNGKGLDGRSALDHFRIPAAAASPPPPPQ

SEQ ID NO: 5802 - protein, 266 aa, Zea mays
MRARTACLVPRVRDGRLPSTVLPTWARGPREGPDQKKRAAERSMLFLRCQPRVPSASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 5803 - protein, 138 aa, Triticum aestivum
MAEATLEGSEPVDLSKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHG

SEQ ID NO: 5804 - protein, 437 aa, Saccharomyces cerevisiae
MGQGVSSGQDKKKKKGSNQKPKYEPPVQSKFGRKKRKGGPATAEKLPNIYPSTRCKLKLLRMERIKDHLLLEEEFVSNSEILKPFEKKQEEEKKQLEEIRGNPLSIGTLEEIIDDDHAIVTSPTMPDYYVSILSFVDKELLEPGCSVLLHHKTMSIVGVLQDDADPMVSVMKMDKSPTESYSDIGGLESQIQEIKESVELPLTHPELYEEMGIKPPKGVILYGAPGTGKTLLAKAVANQTSATFLRIVGSELIQKYLGDGPRLCRQIFKVAGENAPSIVFIDEIDAIGTKRYDSNSGGEREIQRTMLELLNQLDGFDDRGDVKVIMATNKIETLDPALIRPGRIDRNILFENPDLSTKKKILGIHTSKMNLSEDVNLETLVTTKDDLSGADIQAMCTEAGLLALRERRMQVTAEDFKQAKERVMKNKVEENLEGLYL

SEQ ID NO: 5805 - protein, 491 aa, Escherichia coli O157:H7 EDL933
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 5806 - protein, 192 aa, Mitthyridium sp. Wall 3848
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFTTDSHSSIFDAKAGIALSDT

SEQ ID NO: 5807 - protein, 387 aa, Gaeumannomyces graminis var. graminis
MLRSSAFALLAWASLSEAQFGIKHTQYGTSEPVYPSPEILGSGGWEAGLAKAKDFVAQLTPEEKANMVTGTPGPCVSNIAPVPRLNFTGLCLQDGPATLRQATYVTVFPGGVSAASSWDKDLIYKHGVLMAREFRDKGSHIILGPVIGPLGRSPYAGRNWEGFSPDSYLAGVLAEQTVKGMQSVGVQTCTKHFIGNEQEEQRNPTTVDGKGVEAISSNIDDRTMHETYLWPFYNAVRAGTTSIMCSYQRINGSYGCQNSKTLNGLLKTELGFQGFVVSDWAATHSGVASIEAGLDMNMPGPLNFFAPTLESYFGKNITTAVNNGTLSSRRVDDMIERIMTPYFALGQDKDYPPVDGSTVPIGYLQPDAWNHEFPLGPTVDVRRNHHE

SEQ ID NO: 5808 - protein, 479 aa, Hymenena laciniata
RLKNERYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDVNLPLGIFFTQDWASLRKVTPVASGGIHCGQMHQLLDYLGNDVVLQFGGGTIGHPDGIQAGATANRVALESMVIARNEGIDYVTEGPAILRDAAKTCGPLQTALDLWKDITFNYTSTDTPDFVETPTANV

SEQ ID NO: 5809 - protein, 509 aa, Oryza sativa (japonica cultivar-group)
MSQSSPFFSVARAHAGAGGRAAAAALLLRHPVAQLPPRIHGLRYYPSAIVSPAKTLNSHLSLPHATISSFANADNGSSGQADATESEEEQNGESELSEMAKAFHISPRMAMSISVVIAFAALTVPLAMQSVVFHGTNKMKALAYLTLLSGFYMAWNIGANDVANAMGTSVGSGALTLRQAVLTAAVLEFSGAFLMGTHVTSTMQKGILVASVFQGKDSLLFAGLLSSLAAAGTWLQVASSYGWPVSTTHCIVGAMVGFGIVFGGVNAVFWSSLARVSSSWVISPLMGAAVSFIVYKGIRRLGDLLSSEAEKIASADKANAQQVGFLSDIAGPTGAQLQIVYGVFGYMQVLSACFMSFAHGGNDVSNAIGPLAAALSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVASWLVTIPVGAVLSIFYTLLFTKILAYFM

SEQ ID NO: 5810 - protein, 473 aa, Magnetococcus sp. MC-1
MANKEAVNKVLGMIDANNVRFVDFRFTDFKGKWQHITAPARMLTEDVFETGLGFDGSSITGWCEINNSDMAYVPDPESAVMDPFSEDATLILACNIIDPFTGEDYSRDPRSVAKRAEAYLAYTGIADTAYVGPEAEFFVFDSVRYNVGMNNVSYHIDSEEGAWNTGTEYEDGNTGHRPGIKGGYFPVPPVDSLQEMRNEMSNLMEEMGLTIEFHHHEVATAGQCEIDMRFGTMLHTADNIQKYKYVVHNVAHQYGKTATFMPKPMAGDNGSGMHCHMSIWKDGKPLFAGNQYADLSEMALHFIGGIKKHAKALNAFTNPSTNSYKRLIPGFEAPVLLAHSSRNRSASIRIPASNSPAGKRCEIRFPDPSANPYLAFAALLMAGMDGVENKIDPGPSMDKNLYDLPPEELKDIPTVCGSLREALEELSKDREFLLKGDVFSNDLIDAYIKMKMDEVYAVEHCPHPIEFQNYYSV

SEQ ID NO: 5811 - protein, 334 aa, Neisseria meningitidis MC58
MSIKVAINGFGRIGRLALRQIEKAHDIEVVAVNDLTPAEMLLHLFKYDSTQGRFQGTAELKDDAIVVNGKEIKVFANPNPEELPWGELGVDVILECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVASGSLTELVSILERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 5812 - protein, 366 aa, Bacillus caldotenax
MGNYRIAVLPGDGIGKEVTSGAVEVLKAVGIRFGHEFTFEYGLIGGAAIDEAGTPLPEETVRLCRESDAVLLGAVGGPKWDDNPPHLRPEKGLLAIRKQLDLYANLRPVVCYDSLVSRSPLKPDLVQGVDFVIVRELTGGIYFGQPSAVVENGEEKAVDTLLYKKEEIERIVRMAFELARGRRKKVTSVDKANVLSSSRLWREVAEEVANEFPDVTLEHMLVDMRMQLIRAPKQFDVIVTENMFGDILSDEASMLSGSLGMLPSASLSASGPSLYEPVHGSAPDIAGMNKANPIAAILSAAMMLRLSFGLTAEAGGRARVWQALALGSGSRLGQRRPHLSTNEMVEEIKAAVLDYTAIAQIMTVYA

SEQ ID NO: 5813 - protein, 363 aa, Lolium perenne
MVQPVFDAALLSGQSDIPSQFIWPADESPSPDATEELHVPLIDIGGLLSGDRVAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 5814 - protein, 359 aa, Oryza sativa
MKVIEKIQEAAADGRTVFSFEYFPPKTEEGLDNLFERMDRMVAHGPNFCDITWGAGGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPEAHPDAIQSTEGATPEAYSNDLAYLKQKVDAGADLIITQLFYDTDIFLKFVNDCRQIGITCPIVPGIMPINNYKGFLRMTGFCKTKIPAEITAALEPIKDNEEAVKAYGIHLGTEMCKKILATGIKTLHLYTLNMEKSALGILMNLGLIEESKISRSLPWRPPTNVFRVKEDVRPIFCSLDHVGRGKKLQEEWAVPVKSGEDITK

SEQ ID NO: 5815 - protein, 436 aa, Neocallimastix frontalis [sequence omitted]

SEQ ID NO: 5816 - protein, 350 aa, Burkholderia fungorum
MKSAKNLRPVRSTRRRWGHRLARWAGLLSYDLFPTRLRPMSTSALPARRAPDSFAILLMIGLCAIWGLQQVAIKSTNVALPPVFQAGLRSAIAAVLVWGWARSRGTPLFRDDGTLGAGLLAGVLFASEFVCIFLGLTLTSASRMAVFLYTAPCFTALGLHWFVDGERMRRIQWLGIFVAFAGMALAFADGFLHGRAAQSPVLTGVAGDALGVLAGIAWAATTVVVRATRLAHSSASKTLFYQLTVSAAVLLALALALGQARVETVTPLAMVSLAYQAVVVAFVSYLVWFWLLTRYIASRLSVFSFLTPLFGVTFGVLLLGESFSLRFLMAAVLVLTGIALVNAPAKRVTV

SEQ ID NO: 5817 - protein, 175 aa, Oryza sativa
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFIRIIGFDNVRQVQLISFIAYKPPGCEESGGN

SEQ ID NO: 5818 - protein, 363 aa, Zea mays
  unsure (1)..(363): unsure at all Xaa locations
MAAASSAHLFGLGDGQMQMQPQQQQAPPPPLVNNPAAPPPKKKRRXPASQAPDPDAEVIALSPKTLLATNRFVCEVCNKGFQREQNLQLHRRGHNLPWKLKQKDPSQAQRRRVYLCPEPTCAHHDPSRALGDLTGIKKHFCRKHGEKKWKCDKCSKRYAVQSDWKAHSKVCGTREYRCDCGTLFSRRDSFITHRAFCDALAQESARLPPPGLTASHLYGATNAANMGLSLSQVGSHLASTLGADAHGHHQDLLRLGGSNAASRFEHLLGPSNASAFRPLPPPPSSAFLMGAPQEFGAGDGSGSHGFLQGKPFHSLMHLPDLQGTXRRGCLGVVRLRVSSTLATSQTVQTAQVLPAMAMQARDT

SEQ ID NO: 5819 - protein, 272 aa, Bacillus cereus ATCC 14579
MSAVNQIQADIKEFRKKYNLERIVVVNTASTEEKTKSHYLYQSLKAFETGLRENSPDIRPGMLYAYAAMKSKCAYVNFTPSVTTEIPALQELAELQAVPTAGKDGRTGQTLYKHVLGKMFKQRGLNIVGWYSTNILGNQDGAVLEHPTHSSTKIDSKSIGLEQILGYSHFDHKVRIDYFPVRGDRKEAWDTIDFEGWLGERMTMKINWLGIDSILAAPLIIDLSRFMEHALREGKVGIMEHLSLFFKAPIGTDEYALDKQYQTLLDYVKHFE

SEQ ID NO: 5820 - protein, 145 aa, Zea mays
  unsure (1)..(145): unsure at all Xaa locations
ALAVQVSLILIPGQIYAVNNARYSDWPEVLTXFIDTLRQRXGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 5821 - protein, 222 aa, Magnetospirillum magnetotacticum
MAALIAPSILSADFANLERDLNAIATADYAHVDVMDNHFVPNLTLGLPVFERLAQVSPVPIDAHLMIEDPDRWAPAYAEAGAASVTFHAEAAAAPVRLARELRRLGARAGVALRPATPVEPFLDLLTEVDMILVMTVEPGFGGQSFIEGTLPKIRRAREAVSESGLDVWIQVDGGVSRSTIERAADAGANVFVAGSAVYGAENVPEEIQALRELAEASAHAH

SEQ ID NO: 5822 - protein, 455 aa, Myriogramme manginii
VIKETDILALFRVSPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTSATMEEMYERAEFAKDLGTIIVMIDLVIGYTAIQSMAIWARKNDMILHLHRAGNSTYSRQKIHGMNFRVICKWMRMAGVDHIHAGTVVGKLEGDPLMIKGFYNTLLLTQLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 5823 - protein, 145 aa, Glycine max
  unsure (1)..(145): unsure at all Xaa locations
RNLAREKGHKTNRTKEITKSKEEDDKGNSNAIKYEAGEHPEQEVANKNVQYDGDSKRDMEEKKSEREKGFFLKKRKKKSREEKLLAAPKIXDEEKRRELSTRKEGKVEKEGKLERNRKKETRHKKMNKGTWVPPSTTEEKEMAKE

SEQ ID NO: 5824 - protein, 374 aa, Glycine max
MQRLKLQLVLFLSISTCHTVFSFTDGLLPNGNFEQGPKPSQLKGSVVTGHDAIPNWTISGFVEYIKSGQKQGDMLLVVPEGDYAVRLGNEASIKQKLKLIKGSFYSITFSAARTCAQEEKLNVSVVPTTEKRDWGIIPIQTMYGSNGWESFTCGFRADFPEAQIVIHNPGKEEDPACGPLIDSVALKVLYPPKRTRANLLKNGNFEEGPYIFPNSSWGALIPPHIEDSHGPLPGWIVESLKAVKYIDSDHFAVPEGKRAIELVAGKESALAQVVITTIGKTYDLTFAVGDANNACESSMMVEAFAGTNTVQVPYQSKGKGGFVRGKLRFKAVSTRTRLRFLSTFYTMKSDNSGSLCGPVIDDVKLLGVRYPTLA

SEQ ID NO: 5825 - protein, 394 aa, Triticum aestivum
MAAAILRRLSPVASQRVPPRLLPPTLARGVSDSTEPLTVETSIPFTSHVVDPPSREVTTTPRELAAAFRDMALMRRAEIAADSLYKAKLIRGFCHLYDGQEAVAVGMEAAITRRDAIITAYRDHCLYLARGGGLVAAFAELMGRVDGCSRGKGGSMHFYKKDANFYGGHGIVGAQVPLGCGLAFAQRYRKEGTVTFDLYGDGAANQGQLFEALNMAALWKLPVILVCENNHYGMGTAEWKASKSPAYYKRGDYVPGLKVDGMDFLAVKQACKFAKEHVLEIGPIILEMDTYRYHGHSMSDPGSTYRTRDEIAGIRQERDPIERVRKLLLTHDLATAQELKDMEKEIRKEVDTAIAKAKESPMPDTSELFKNVYVNDCGLESFGVDRKVVRTVLP

SEQ ID NO: 5826 - protein, 788 aa, Xanthomonas axonopodis pv. citri str. 306
MFRQEGRIQPPAPSRTTPPMSTDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEEVKLATTGMGAAGISCVNMLVSLGLKPENILALDRDGVIHTGRTDLDPDKQRYARDTDKRTLAEIVEGADIFLGLSAAGILKPEMVASMARQPVIFALANPNPEITPEAAKAVRPDCIIGTGRSDYPNQINNVLCFPYLFRGALDVGATGINEEMKIACVKAIAAMARREASDLGAAYGGETPSFGPEYLIPRPLDPRLLVELSSAVAQAAMDSGVATRPITDMEAYRDKLGQFVYRTSLMMKPVYDRARADKQRVVYAEGEEEVVLRAVQNVVDEGLAFPILIGRPDVIEARIERMGLRLTAGVDFEITNILDDPRFNDYWQYYHALTERRGVTVTAAKELMRSRPTLIAAVMVARGEADAMLSGVVGRFHKKLGYARSVIPLEPRVSSTSAMTGVINQLGVFFFLDTHVQEDPTVEQVVEATLQAAYRLKLFGIEPNIALLSHSNFGSHDSRDALKMRQVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRRQRDAEKAAADKGND

SEQ ID NO: 5827 - protein, 611 aa, ASPERGILLUS NIDULANS FGSC A4
MPSLTSVVGLSASLVGLVAGQYFPPTPEGVKVIHSKHQKGVTISYKEPEICETTPGVKSYSGYVHLPPGTLNDLGLDQQYPINTFFWFFESRNDPVNAPLSIWMNGGPGSSSMIGLMQENGPCRVNIDSNSTELNPWSWNNYVNMLYIDQPNQVGFSYDVPTNGTYNQLTGVRDVSGWSTVPEQNNTFYVGTFPSLNASATANTTENAARALWSFAQTWFTEFPAYKPRDDRVSIWTESYGGRYGPSFSAFFQEQNEKIANGSLTTPGESHYIHLDTLGIINGCIDLLVQAPSYPEIAYNNTYGIEAINETIYEFAMNAWSKPGGCKDQIVRCRQLAAEGDPRMYGNNKTVNAACQAADRYCSNNVEGPYPLFSGRGYYDIAHFDPDPFPPPYYLGYLSQHWVQDALGVHINFTESIDSVYNAFGTVGDYARSDVRGYLEDLAYVLDSGIKVALVYGDRDYACPWNGGEQVSLQVDYSHADKFRAAGYAPLHTNSSYVGGSVRQYGNFSFTRVYQAGHEVPAYQPETAYEIFHRAMFNRDIATGKISTAKNSTYSTKGPSSTWNVTNTVPDSPEPTCYILSLSSYCTEEQTQSVANGTALIKDYIVVEESL

SEQ ID NO: 5828 - protein, 311 aa, Glycine max
MEGSGSGVVTVYGNGAITETKKSPFSVKVGLAQMLRGGVIMDVVNAEQARIAEEAGACAVMALERVPADIRAQGGVARMSDPQLIKDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIVAPYDLVMQTKQLGRLPVVHFAAGGVATPADAALMMQLGCDGVFVGSGVFKSGDPAKRARAIVQAVTHYSDPEVLAEVSCGLGEAMVGINLTDDKVERFANRSE

SEQ ID NO: 5829 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYISDEPWGWYQSPSKL

SEQ ID NO: 5830 - protein, 507 aa, Debaryomyces occidentalis
MKFATILSTTALALSSLVASKPIFLSKRDAGSSAAAAWRSESIYQLVTDRFARTDGSTSATCNTGDRVYCGGTFQGIIDKLDYIQGMGFTAIWISPVVEQIPDDTGYGYAYHGYWMKDIYAINSNFGTADDLKNLSNELHKRNMKLMVDIVTNHYAWNGAGSSVAYSNYNPFNQQSYFHDYCLITNYDDQTNVEDCWEGDNTVSLPDLRTEDSDVSSIFNLWVAELVSNYSIDGLRIDSAKHVDESFYPSFQSAAGVYLLGEVYDGDPAYTCPYQNYMSGVTNYPLYYPMLRFFQGTSNSVDELNAMISSLESDCKDITLLGNFIENHDQPRLPSYTSDSALIKNAIAFNLMSDGIPIIYYGQEQGYSGSSDPNNREALWLSGYSTSNGYYKLISSVNQIRNQAIYKDSKYTTYWSDVLYASGHVIALQRGADDQRIVSVFNNLGSSGSQTVTFSTKYSGGEKVVDVLTCQTSYANSDSTLTVSISGGAPRIYAPASLIANSGICNF

SEQ ID NO: 5831 - protein, 526 aa, Nicotiana tabacum
MDSARGWFQKLSSTKKDPMASGREDGKPVSAEEASNITKQRVAAAKQYIEKHYREQMKNLQERRERRILLEKKLADADVSEEDQNNLLKFLEKKETEYMRLQRHKMGADDFELLTMIGKGAFGEPICMIGFSVITGQNCREKTTGQVYAMKKLKKSEMLRRGQVEHVKAERNLLAEVDSDCIVKLYYSFQDDDYLYLVMEYLPGGDMMTLLMRKDILTEDEARFYVAETVLAIESIHKHNYIHRDIKPDNLLLDRYGHLKLSDFGLCKPLDCSTLEEKDFSVGDNANGGSRSDSPPAPKRTQQEQLEHWQKNRRMLAYSTVGTPDYIAPEVLLKKGYGMECDWWSLGAIMYEMLVGYPPFYSDDPMSTCRKIVNWKNHLKFPEEAKLSPEAKDIISRLLCNVTERLGSNGADEIKVHSWFKGIDWDRIYQMEAAFIPEVNDELDTQNFEKFEESESHSQSGSRSGPWRKMLSSKDINFVGYTYKNFKVVNDYQVPGMVELKKTNTKPKKPTIKSLFGDESEASEDN

SEQ ID NO: 5832 - protein, 159 aa, Glycine max; identical to SEQ ID NO: 1504

SEQ ID NO: 5833 - protein, 252 aa, Nitrosomonas europaea ATCC 19718
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 5834 - protein, 308 aa, Cyanidium caldarium
NGFGRIGRLVLRAAVEKGTVEVVAVNDPFIFPDAAYAAYMLQYDSTHGAFPGEVGSDGEHLVVNGKKLACFAIRDPAEIPWGSVGADYVVESTGVFTVTEKASLHVKGGAKKVVISAPSKDAPMFVMGVNHDAYTKDLTVVSNASCTTNLFGAAGQDHRRGVRHRDGPHEHHPRGDGHAKDGGWAELQRLARCRGAFQSIIPSSTGAAKAVGKVYPKLNGKLTGMAFRVPVPDVSVVDLTVTLKKETNYEEIKKAVKQASQSPHYKGIVAYTEHPIVSADLVHNPYSSVFDAEAGIMLSPTFVKLVSW

SEQ ID NO: 5835 - protein, 432 aa, Magnetospirillum magnetotacticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSAAYGAFLGGVVLGNSAQRDMLLKRAQPIGSVLLMVFFLSIGLLLDFKFIWKNLGTVLTLLAMVTVFKTALNVAALRLARQDLASAFLAGVALAQIGEFSFLLAETGKAVKLINAKETNLVVAVTVLSLVLSPFWLFTMRRMHRVAAVHVHSFRELVSRLYGDEARNARRARTLVRRGSWRDDHNAGPGSGIST

SEQ ID NO: 5836 - protein, 159 aa, Glycine max
MGSEGSSVVVPRNFRLLEELERGEKGIGDGTVSYGMDDADDIYMQSWTGTIIGPPSTVHEGRIYQLKLFCSRDYPDNPPSVRFQTRINMTCVNQETGVVEPHLFPMLANWKRERTMEDILIQLKREMMSPQNRKLTQPPEGNEESRVDQKGLVVRCCIV

SEQ ID NO: 5837 - protein, 75 aa, Glycine max
  unsure (1)..(75): unsure at all Xaa locations
MAFSMISSPAVTTVNRAGAGMVAPFTGLKFMAGFATRKTNFDFTCIASNGGRVQCTHVRPPVAKKXFATLSYLSD

SEQ ID NO: 5838 - protein, 251 aa, Prochlorococcus marinus subsp. pastoris str. CCMP1378
MPETNSKNSVGVNRPIQIIPSVLPADWANMGACVKDLEEAGVDRIQFDVMDGNFVPNLTFGPEMIAACRKYCEVPFETQLMVSQYNCETMLEAYVKATKGPNGEPGVVIAHAEANVHLHRVLGKIRDLGGSPSVALNPHTPFEMIENIMDMVDHVLVMTVNPGFGGQAYIPTMLNKIRKIRNFVIEKNLNVDIEVDGGIKANWTISQCAEAGANCFIAGSGMFAYPTLKEGCDELRSVALDAQNGKIISEP

SEQ ID NO: 5839 - protein, 189 aa, Glycine max
ERQAVIRKKLQLVGVTAMLIACKYEEVSVPTVEDFILITDKAYTRNEVLDMEKLMMNILQFKLSVPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 5840 - protein, 692 aa, Burkholderia fungorum
MRVRFANRASAMRTIRLAQQTRSYRSATLRGPSRGVSTTSRAAPDGQFRIAVVFPAQGTDFLAFMTDNNHEHKQPLPSLAIAAIGVVFGDIGTSPLYSLKEAFSPSHGIPLTDQSILGVISLLFWAIVIVVGVKYVLFVMRADNNGEGGVLALMALALRSLDEKSKMAGLLMMLGIFGACMFYGDAVITPAISVISAVEGLEIAAPHLSHLVLPLTIVILILLFWIQRHGTAMVGRLFGPIMVLWFVVLAALGLWHILQSPSVIRALNPCYAYTFMAAHVLQAYVVLGSVVLVLTGAEALYADMGHFGAKPIRMAWYVLVMPSLVLNYFGQGALLMHDPKAIENPFFLLAPDWALLPLVVLSTIATVIASQAVISGAYSLTSQAIQLGYVPRMKILHTSELAIGQIYVPVVNWMLLFIILCIVIAFKSSDNLAAAYGIAVTATMVITTILACVVMVKVWNWNKLLVALIIGVFMTVDLGFFGANLLKVEEGGWLPLGIGALLFFLLMTWYKGRMIVKERTAADGIPLMPFLQGLLAHPPHRVSGTAIYLTGSDSLVPVSLLHNLKHNKVLHERTIFLTFVTRDIPYVNDADRVTVKDIDGGLYLVKAAYGFNETPDVKAVLLEVGRTHDMTFELMDTSFFLARETVVPTQLPGMSVWRERVFAWMHQNAAKPTDFFSIPANRVVELGTKIEI

SEQ ID NO: 5841 - protein, 477 aa, Corynebacterium glutamicum ATCC 13032
MAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 5842 - protein, 487 aa, Zea mays
RPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 5843 - protein, 312 aa, Chara vulgaris
KVGINGFGRIGRLVLRASLNHPNVQVVAVNDPFLDPEYIVYLFKYDTVHGKYKGEVGLSADKKLVVDGKEIAIFALRDPAAIPWGEAGADYVVESTGVFTAKDKAAAHLKGGAKKVVISAPSGDAPMFVMGVNEDKYTADLDVISNASCTTNCLAPLAKVMNDNFGIVEGLMTTVHAVTATQKTVDGPSGKDWRGGHGAGFNIIPSGTGAAKAVGKVLPELNGKLTGMAFRIPTADVSVVDLTVRLAKSTTYDEIKAVIKKASESDLKGILGYTDDDVVSSDFIGDVRSSIFDAKAGIALNGNFVKLVSWYD

SEQ ID NO: 5844 - protein, 297 aa, Candidatus Carsonella ruddii
MKFFDFIKNKTKISIDSADINFIKNKLFNAATTNPSLILKSILSKVYNKLLYAFLLKNFKKKIIDSDYNISLYDKLLVNIIANIIPYIEEKISIEIPARISFNYNKIIFYSYKIIYLCEKIGINLKKILIKIPATNSGIKAAKQLKNNNINSNLTLIFNLTQAKKCFDSGIYIISPFVGRVSDSIYCKYDSGVNFVKNLVNLKNNNNYSTKIMAASFRNINQIINLTCCDFITISPIYYNKLKNINYKNSVLNYKSNIDFCNNENYNSIKLLNNGIKQFDIDHNRLIKLISNLINNL

SEQ ID NO: 5845 - protein, 310 aa, Staphylococcus chromogenes
GFGRIGRLAFRRIQDVENIEVVAVNDLTDDDMLAHLLKYDTMQGRFTEEVDVIDGGFRVNGKEVKSFSEPEPSKLPWKDLDVDVVLECTGFFTSKEKAEAHIEAGAKKVLISAPGTGDLKTIVYNVNHEELDGSETVVSGASCTTNSLAPVAKTLNDEFGIVEGLMTTIHAYTGDQNTQDSPHRKGDKRRARAAAENIIPNSTGAAKAIGLVIPEIDGKLDGGAQRVPVATGSLTELTVVLDKEVSVEDVNNAMKNATNESFGYTEDEIVSSDVVGMTFGALFDATQTRVMTVGDRQLVKVAAWYDNEMS

SEQ ID NO: 5846 - protein, 381 aa, Pisum sativum
CVFDAKSVLSSSRRKHVNGSGVRCMAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 5847 - protein, 340 aa, Ginkgo biloba
MAPTRVQYVAESRPQTIPLEFVRPVEERPINTTFNDDIGLGRQIPVIDMCSLEAPELRVKTFKEIARASKEWGIFQVINHAISPLLFESLETVGKQFFQLPQEEKEAYACTGEDGSSTGYGTKLACTTDGRQGWSDFFFHMLWPPSLRDFSKWPQKPSSYIEVTEEYSKGILGVLNKLLSALSISLELQESALKDALGGENLEMELKINYYPTCPQPEVAFGVVPHTDMSALTILKPNDVPGLQVWKDEKWITAHYVPNALIIHIGDQIQILSNGKFKSVLHRSLVNKEKVRMSWPVFCSPPLDTVIGPLKELIDDSNPPLYNARTYREYKHRKINKLGQ

SEQ ID NO: 5848 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 5849 - protein, 611 aa, Oenococcus oeni MCW
  unsure (1)..(611): unsure at all Xaa locations
MTKMIAGRALVKALEDWGVDHVYGIPGGSINHTVEGLYLEQDKVKYIQVRHEEVGALAASADAKFTGKIGVAFGSAGPGATHLFNGLYDAKMDHVPLLAIIGQVPQETMNTNYFQEMDEVPLFSDVSVYNRTVTTAEQIPYVINQAIREAYRQKGVATVVLPENLAAKEIDYKETKTPKVVANNFSQKVDSKAVSDTLAMLKAAKHPLIYAGRGLLGARDVLTKFSEQFNIPVMNTVPATGVISTDDPNFIGTFGRLGSKSGFEALQHTDLILFLASEFPFAGFWPKNIKVIEVNNNPFDIGKTVDVDYAVISDAKSYLQALINTGQTLPAGNWLKANQENKRNWDNWLAELAKDESDGLNPESVTAKIASMVGPNDTYAVDTGNVSEWGARGLPMNHNQRFAISGLFATMVLXXXXXXXXXXXXXXXXXXXXXXXXXXXXXXXXXXXXXXXXXXWSLSGDGGFSMVVQDLITEVRYGLPVINIVFSNDRFGFIYHEQVQTKQHFYGVDLTGADWAKVSEGLGAISFTVKTIADIDQVFTKIKKLQESGNKKPIVVNAVIKKDDPFPTDYMPLDPKLYGQDAVDQYAEKYHFDLEKQPSLGALLRAQGDNL

SEQ ID NO: 5850 - protein, 201 aa, Papaver nudicaule
DAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPSLNIGGNYQGRSSGREDEVPQTQARPTILMPSWMLC

SEQ ID NO: 5851 - protein, 369 aa, Arabidopsis thaliana
MSIEKPFFGDDSNRGVSINGGRYVQYNVYGNLFEVSKKYVPPLRPIGRGASGIVCAAWNSETGEEVAIKKIGNAFGNIIDAKRTLREIKLLKHMDHDNVIAIIDIIRPPQPDNFNDVHIVYELMDTDLHHIIRSNQPLTDDHSRFFLYQLLRGLKYVHSANVLHRDLKPSNLLLNANCDLKIGDFGLARTKSETDFMTEYVVTRWYRAPELLLNCSEYTAAIDIWSVGCILGEIMTREPLFPGRDYVQQLRLITELIGSPDDSSLGFLRSDNARRYVRQLPQYPRQNFAARFPNMSVNAVDLLQKMLVFDPNRRITVDEALCHPYLAPLHEYNEEPVCVRPFHFDFEQPSLTEENIKELIYRESVKFNP

SEQ ID NO: 5852 - protein, 361 aa, Haloferax volcanii
MQPRDLSAHAPYVPGRGTEEVARELGMDPEDLTKLSSNENPHGPSPKAVAAIEDAAPTVSVYPKTAHTDLTERLADKWGLAPEQVWVSPGADGSIDYLTRAVLEPDDRILEPAPGFSYYSMSARYHHGDAVQYEVSKDDDFEQTADLVLDAYDGERMVYLTTPHNPTGSVLPREELVELAESVEEHTLLVVDEAYGEFAEEPSAIDLLSEYDNVAALRTFSKAYGLAGLRIGYACVPEAWADAYARVNTPFAASEVACRAALAALDDEEHVEKSVESARWSRDYLREHLDAPTWESEGNFVLVEVGDATAVTEAAQREGVIVRDCGSFGLPECIRVSCGTETQTKRAVDVLNRIVSEVPTA

SEQ ID NO: 5853 - protein, 151 aa, Zea mays
ALRTNGGDEGGFAPNIPENQEGLELLKASIEKGGYPGKGGIGMDGGASEFFREKDPTHDPNLKGENNDGSNKNSCDSLKDLFQSFGSEYPIESNEDPFDQEDWSTHAKLTDEIGQKVPNGGDELLVTHPTKGGKGINEKTCHALLLKGNPI

SEQ ID NO: 5854 - protein, 464 aa, Cytophaga hutchinsonii
MPNVTPELYDSVMLIKQQMLVDSLNHAQAALNDSLHATNDLMFKTRTELQLTQNSLANSSFKANNIWMMVATAFVFIMHLGFATLESGLTQAKNTTNVLFKNSIVPAIGIMTHALCGFNLMYPGFEFGVSMDFIGFKGWGVELPEGGETFVYNPGMTYWTDFLFQAMFAATAATIVSGAVAERIKLFSFMVFSFFFTAFIYPIIGSWKWGGGWLNTIGFSDFAGSTLVHSVGGWAALAGVILLGPRLGKFNKGVINPIQGHSMTSAVIGTFLLWLGWFGFNGGSVLSAEPGMVSRVLVMTCISGSSGAIAAAFSIFAINKHFDLSMVLNGILAGLVGITAGADQMGIIDATLIGLISGCLVVFAIITFEKIRLDDPVGALSVHLVCGIWGTLAVALFGAKAGAAQFVTQLIGIGSVAVAAFGSSFLILLAIKYTIGLRVGKEEEIYGLDASEHYMEAYPNFMSK

SEQ ID NO: 5855 - protein, 293 aa, Leptospira interrogans
MKKVSEIYGSAKGPVYSFEFFPPKTPEGDSKLMETVKELSLLNPDFVTVTYGAGGSTRDKTVQILSQISKDYSFPTVSHFTCVGANKNQILETLKGIRSSGILNLMALRGDPPKGEGEFKKVENGFGNATELVSFIRSEKLDFCIGGGCYPEKHPNAKTLEEDVENLKLKVDAGTDFLVSQLFFVNSIFENFLNLVRKVGIQVPVIPGIMPITSFSQIDRFRSMAGCEFPSSLIQDLQEVEHRPEEFYRRSLNFSVKQCRELLAMGVPGIHLYTLNQSHASYDIVRELKGESA

SEQ ID NO: 5856 - protein, 180 aa, Echinochloa phyllopogon
PSGASTGIYEALELRDRPSDYLGKGVLKAVDNVNSIIGPAIYGKEPTEQVDIDNLMVQQLDGTSNEWGWCKQKLGANAILAASLAAVKAGSMVKIPLYQHIANLAGNKKIVLPVPALNVINGGSHAGNKLAMQEFMILPTGVSSFKEPMKMGVEVYHNLKSIIKKKYGQDATNVGDEGGF

SEQ ID NO: 5857 - protein, 458 aa, Oryza sativa
MADSPRRRNGLLRDQVQLVKRKDTNRYEIVRFPDPLSFEKGFFVMIRACQLLVQHNEGMIFVGVAGPSGAGKTVFTEKVLNFMPGVAVISMDNYNDASRIVDGNFDDPRLTDYDTLLENIHGLKEGRSVQVPIYDFKMSCRTGYRIVIIEGIYALSEKLRSVLDLRVSVTGGVHFDLVKRVYPMYKAFIEPDLQTAHIKIINKFNPFSGFQNPMYILKSPRTITPTDIKVALGEDHTESIEETYDIYLLPPGEDPESCQSYLRMRNREGKYNLMFEALPEDLKTKLSIDDELVSSPKEALSRGAITQLSEQISTLNERMDEFTSRVEELNCKFAIKKSSTSQQNLALPNETCNGSAPTNLFVSHLGNGTLIPHSSSSNQLLKESPIVDEINAISRGQRQVIHQLDNLTSLLHEHLALTRQGNAVRRNGILEMDMSICPLIALTIGGFGYLVFKSLNRS

SEQ ID NO: 5858 - protein, 476 aa, Schizoseris griffithsia
  unsure (1)..(476): unsure at all Xaa locations
NDRYESGVIPYAKMGYWDPDYVVKETDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAAXXEDMYERAEFAKQLGTVIIMIDLVIGYTAIQSMGIWARRNDMILHLHRAGNSTYSRQKIHGMNFRVICKWMRMAGVDHIHAGTVVGKLEGDPKMIKGFYNTLLQPFLDVNLPEGIFFTQDWASLRKVTPVASGGIHCGQMHQLLDYLGNDVVLQFGGGTIGHPDGIQAGATANRVALESMVIARNEGRDYVTEGPQILRDAAKTCGSLQTALDLWTDITFNYTSTDTADFVETPTANV

SEQ ID NO: 5859 - protein, 317 aa, Vigna radiata
MANFPVVDMGKLNTEERGTAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 5860 - protein, 348 aa, Helicobacter pylori 26695
MRVQSKGFAIFSKDGHFKPHDFSRHAVGPKDVLIDILYAGICHSDIHSAYSEWKEGIYPMVPGHEIAGAIKEVGKEVKKFKVGDVVGVGCFVNSCKACKPCKEHQEQFCAKVVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNEHKKQDALSMGVKHFYTDPKQCKEELDFIISTIPTHYDLKDYLKLLTYNGDLALVGLPPVEIAPALSVFDFIHLGNRKVYGSLIGGIKETQEMMDFSIKHNIYPEIDLILGKDIDTAYHNLTHGKAKFRYVIDMKKSFD

SEQ ID NO: 5861 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLCSQTPNGVLEVSACCFSFKTHDSSSSYTHLS

SEQ ID NO: 5862 - protein, 375 aa, Lycopersicon esculentum
TRLIAKGQEPVQKNKTKPLVTKGVAARKVGVPAKAEAIKKDYVKAKAGTISGICPEEDVKTIEKIPLKERKVRKSGKTLTSILTARSKAACGLSNKPRSQIVDIDAADIDNHLAGVEYVEDIYKFYKLTEDENRPCDYMDSQPEINDRVRAILVDWLIEAHKRFELRPESLYLTVNIMDRFLSEEPVPRRELQLLCISSMLIASKYEEIWAPEVNDFLTITDNAYVRDQILLMEKVILGKLEWYLTVPTPYVFLVRYIKAAVPSDQEMENMTFFLAELGLMNYTTVISYCPSKIAASAGYAARSTLNRSPRWTDTLKHHTGYTEDQLRECAKQLVSFHFGAAENKLKAVYRKFSSPDRCAVALLPPARDVHIGSS

SEQ ID NO: 5863 - protein, 83 aa, Bacillus anthracis str. A2012
MVLLMTVNPGFGGQKFIHSVLPKIKQVAEMVKERNLEVEIEVDGGVNAETARLCVEAGANVLVAGSAVYNQKDRGEAIRVIRG

SEQ ID NO: 5864 - protein, 193 aa, Zea mays
  unsure (1)..(193): unsure at all Xaa locations
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKXPKTIEVKVAFREQAVAVLLKLCVFQFASFFGITNHPI

SEQ ID NO: 5865 - protein, 300 aa, Prochlorococcus marinus str. MIT 9313
MSWKVADIPDQKGRVALVTGANSGLGLETAKALLNKGARVIMACRSLPTGEDVRQVILERNDSTKLDLIELDLADLASVRRAAEQVESQYSRVDLLINNAGVMATPKTLSKQGLELQFAVNHLGHMALTLKLLPLLAKQHGARVVTVTSGAQYMGRIAWDDLQGIKQYDRWAAYSQSKLANVMFALELDKRMRQTASGIASLLAHPGLARTNLQPKSVAANKSWQEGLAYRLMDPMFQSAAMGSLPQLHAATAPTAQGGEQYGPRFNFRGYPKLCSVAPLALREEDRQRLWSISEKLLEI

SEQ ID NO: 5866 - protein, 278 aa, Zea mays
  unsure (1)..(278): unsure at all Xaa locations
SVLMKGSKTLLFGEKEVAVFGCRNPEEIPWGSVGAEYVVESTGVFTDQEKAAAHLXGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSPDFQGDGRSSIFDAKAGIALNGNFVKLVSWYDNEWGYSTRVVDLIRHMNITK

SEQ ID NO: 5867 - protein, 459 aa, Xanthomonas campestris pv. campestris str. ATCC 33913
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAYWVRRNQSPTAR

SEQ ID NO: 5868 - protein, 820 aa, Podospora anserina
MSILQKTYDESYLTCSTAVYYESQGNEDEAMRCWRQALEQLYDPHANRILPNFNPRSETEKALVESLRQLELQCKERIDLLEALRLSRLSAPQHDSLSSSSRPSKSSSDSHDGGISGQQDGGWIGNGTIPAVNYTDLSRPNTLRRLSSQNRTSSSEQAVASSRGPQHGSMPPPLPARKPLPSTASIPSPERKPSRTSSPERHTMRTTLRTGTRDKTPKATLRRQPPKSSEVPVPSKAATLAWGTLGHRGSLDQPSGSSPISRPAPNTPTVPEQSRRSLELSKRLWDSNSRRLVTPRTRSPNKDTDSAPATDPRRSGEYPFPRASSISISAASTALNALALKESSDHRSPEREHITRLRTAPPETPRSRAQRDILNNDSNMSEGLPDKPLTRKTSLDSATVSRRSAGASLSAARIKSTPTRSGNKRKTPQLGNNSDRARPRRSSSPVLSESSSSSFETPARRPSGQHKRSTVERQREASLIVDSIIQPSESSEDDEPTKEVKSWKKRKAELLKKLPPGVDEHAAKQILNEIVIQGDEVHWSDIAGLEIAKNALRETVVYPFLRPDLFMGLREPARGMLLFGPPGTGKTMLARAVATESKSTFFSISASSLTSKYLGESEKLVRALFSLAKVLAPSIIFVDEIDSLLSQRSGSGEHEATRRIKTEFLIQWSDLQRAAAGREVGERDKERGDANRVLVLAATNLPWAIDEAARRRFVRRQYIPLPEAETRAVQLKTLLKQQTHTLSDEDINTLVAMTDALAKDAAMGPLRSLGDALLHMTENDIRPIGLSDFIASLATIRPSVSKAGLKEYEDWAREFGERGG

SEQ ID NO: 5869 - protein, 377 aa, Solanum bulbocastanum
MDYRVLSYVSKSITPFSLLLLLYIFPATETTAAAANTTYKAFNLSTITFEEGYSPLFSDFNIERSPDDRSFRLLLNKFSGSGVISTEYYNYGFFSASIKLPAIYTAGIVVAFYTSNADTFEKNHDELDIEFLGNVNGQPWRFQTNMYGNGSVSRGREERYRMWFDPSKDFHQYSILWTPKNIIFYIDETPLREVNRHPAMGGDFPSKPMSLYATIWDASSWATNGGKAKVDYKYEPFATELKDLVLEGCIVDPTEQIPSTNCTDRSAKLLAQDYSYITPERRKSMKFFRERYMYYSYCYDNLRYPVPPPECVIVQSERDLFRDSGRLRQKMKFGGSHSHSHSQTHRKHRPGRSSRRRNKVVGGASKSGRRGSAAAAM

SEQ ID NO: 5870 - protein, 221 aa, Zea mays
MSKVFEGYERQYCEASASLTRKCTAAAALQGEKLKQKAAEIQSGIDGAEALIRKMDLEARNLQPSIRADLLVKIREYKSDLNNLKGALKRVTSINAQQGAREELLESGMADTLGVSADQRSRLLRATERQNQTTDRLRDSHRTMLETEELGVSILHDLSQQRQSLLHAHDVLDEVDNNVGKSRRTIGGMMRRMDRNKWIIGLIIAVLVLAILVILYFKFVH

SEQ ID NO: 5871 - protein, 365 aa, Yersinia pestis KIM
MRLAMKKTYRIAAIPGDGIGHEVMPEGINVLQAAALRWDLDISFENIEWASCEYYQHHGQMMPNDWQRQLQCFDAIYFGAVGWPATVPNHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 5872 - protein, 110 aa, GIBBERELLA ZEAE PH-1
MSRHHPDLVMCRKQAGIAIGRLCDKCDGKCPVCDSYVRPTTLVRICDECSFGNYQNKCVVCGGEGISDAFYCFECTRLEKDRDGCPKIINLGSSRTDIGRQLSIKNVNHM

SEQ ID NO: 5873 - protein, 273 aa, GIBBERELLA ZEAE PH-1
MFSKALTALALVAPLVSAQTFTSCNPLTTTCPPDPAFGKDTVHCDFTKGACPDFKEDAGTSITHNANGAVFTIGGPNQAPTIATGKYIMFGRVDIEVQASTGVGIVTSAVLQSDCLDEIDWEWLGGDNAQVQSNYFSKGDVSTYDRGAFHPVANPVGQFHVYSIEWTPALINWIIDDVVVRTLTYEDAKGGSAFPQTPMQIKLGTWCAGSPDAAEGTIQWAGGLTDFSQAPFKAYYKSISIVDYAGGDAPTTKSVREYIYGDHSGSHGSIRTA

SEQ ID NO: 5874 - protein, 334 aa, Saccharomyces cerevisiae
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELSSEEEEMLQKCKETLKKNIEKGVNFVASK

SEQ ID NO: 5875 - protein, 464 aa, Escherichia coli O157:H7 EDL933
MPDAKKQGQSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAGLNVLFILLTLWLVPETKHVSLEHIERNLMKGRKLREIGAHD

SEQ ID NO: 5876 - protein, 482 aa, Elachista antarctica
NRTRIKSERYESGVIPYAKMGYWDADYNVKETDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHTIGSVIVMIDLVIGYTAIQSMAIWARKYEMILHLHRAGNSTYARQKNHGINFRVICKWMRMCGVDHIHAGTVVGKLEGDPLMVKGFYNSLLLTHMKINLAEGLFFDMDWAALRKCVPVASGGIHCGQMHQLLYYLGDDVGLQFGGGTIGHPDGIQSGATANRVALESMVLARNEGRDYVGEGPEILRRASTTCGPLKAALDLWKDITFDYTSTDTPDFVEVATESR

SEQ ID NO: 5877 - protein, 681 aa, Neurospora crassa
MEKITDKVAALPPDSNYFSLEFFPPKTAMGFANLRDRLERMARGLRPLFVNVTWGAGGSTAQKSLELAEICQRELGLTTCLHLTCTNMSRRLLDKTLEDAKVLGIRNILALRGDPPRAAEYHDENDPEPTDDEEFSWAADLVRYIKKTHGDYFCIGVAAYPEGHAEEAHPREQSLEHDLPYLVEKVQAGADFIMTQLFFDIDAYEHFENTLRDHPSGAFKDVIIIPGLMPIQSYQMIKRTTKLSHAKIPPALMARLDAVKGDDEKVKMEGVAIVSEMIERIKEIKSRTPGPRGFHFYTLNLEKAVAFIAERTNLIPPGTPDEDESAILPDIPQLRINGSSVPTRSIQDLSTRKGSIGSDPRDRVIVANQRPSHPDYEASPSEAGLPAEPVNTRANTLAISEGEGVLGREATWDDFPNGRWGDARSPAYGQIDGYGVSLHVTVPQALQLWGSPKTTEDINKIFIRHLKGELSAIPWSEEGFNDETEAIRDNLIELNSRGWWSLASQPAVNGLRSDDGTFGWGPENGFVFQKAFVEFFIPSADWRVLEAKLKQPDMKDTVCFFATNAAGDFVSTDTINFRARMAAEAEGTAEADHRPHEPSTNAVTWGVFPGKEILTPTIIEEVSFRAWSEEAFGIWSEWAKIYGKGSDTQKLLEDLKEDLWLVNVIHHDYLEKDGLWKLLSQ

SEQ ID NO: 5878 - protein, 394 aa, Nicotiana tabacum
MSCAVAISNSPAFSPASRVPVTKSLCKSASFSSSSPNSSKTLTKFPSFTSSSSSSSSSSSSSPSSPSLQFQILRLQKPLQASASTNRIRNSTECSTSAPVLKRKRPAKLDIPVVSTTFGNFPATPAAATADFVEVEGDGYYVCCKRGRRGPMEDRYSALVDLQGDSKEGIFGIFDGHGGAKAAEFAAENLNKNIMDELVNRKDDDVVEALKNGYLKTDSEFLNQEFRGGSCCVTALVRNGDLVVSNAGDCRAVVSRGGIAETLTSDHKPSRKDEKDRIKTSGGYVDCCNGVWRIQGSLAVSRGIGDRYLKQWIIAEPETKVVGLHPELEFLVLASDGLWDKVSNQEAVDAARPLCTGISKPQPLSASKSLIDLAVSRGSVDDISVMIIQLQRFC

SEQ ID NO: 5879 - protein, 332 aa, Clostridium perfringens str. 13
MVKVAINGFGRIGRLALRLMIDNPEFEVVAINDLTDAKTLAHLFKYDSAQGRFNGEIEVKEGAFVVNGKEIKVTAKSNPAELPWGELGVDVVLECTGFFASKEKASAHLTAGAKKVVISAPAGNDLPTVVYNVNHDILDGSEDVISGASCTTNCLAPMAKALNDNFGLNKGFMTTIHAYTNDQNTLDAPHKKGDLRRARAAAANIVPNSTGAAKAIGLVIPELAGKLDGNAQRVPVITGSLTELVCTLDKKVTVEEVNAAMKAASNESFGYTEDPIVSSDVIGISFGSLFDATQTKIMEVDGQQLVKVASWYDNEASYTNQLIRTLKCLVSK

SEQ ID NO: 5880 - protein, 587 aa, Streptomyces avermitilis MA-4680
MARTVARVIVDALSELGVRQVFGVVGDALNPVTDAIRTTEDVEWVGCRHEEAAAFAASAQSQLSGTLGVCMGTVGPGSVHLLNGLYDAAKSRTPVLAIAGQVPLAELGSDYFQEVDNDALFSDVAVFRATITSPDQLPQLLETAVRNALGRKGVAVLTVPGDLGDRELSADRPTRFSLSTPVSRPEESAVRRAAELLDRAERITLLVGRGARAARADVLTLADRLAAPMVLTLKAKEGFEGEANPFQVGQTGLIGNPAAASALQDADTLLLLGTDFPYRDWYPDGRTVIQVDSEAAHIGRRVPVEVGLVGDTGATVRDLLGHLATAPPGTEGARDRSHLEDARKSFGKWRASQARLADPAHDKGLVGRVRSALDNRAHDIRPEALAAVVDRVADENAVFTSDTGMATVWLSRFVEMRGDRRLLGSYNLGSMANAMPQALGAQCLDRGRQVVAFCGDGGLSMLLGDLMTLKTSRLPVKLVVFDNRRLGMVKLEQEQAGLPEFGTVLDNPDFAAVATAMGITGIRVTDPAELEESVRRAFATPGPVLLDVLTNPDEIAVPAKPTVEQGWGFAVAKVKEVVRSHGDSDGH

SEQ ID NO: 5881 - protein, 242 aa, Triticum aestivum
MGGGNDGHGYPPGGQGGYPPAGYPPQQGGYPPQQGGYPPQQGYPPAPGAYPPAPGAYPPAPGAYPPAPGAGGPDGEKGLLSNIMHGVAGAHGGGHGYPSGGHGYPPQQHGYPQQGYPPQHGYPPQQHGYPPQQHGYPPAGYPGSSGHSGSHGGGGMGMGGMLAGGAAAAAAAYGAHKLSHGGHGGGGHMMGGMMGGHGGYGGGYGHHGGKFKHGKHGHGKFKHGKHGKHGMFGGGGKFKKWK

SEQ ID NO: 5882 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 5883 - protein, 559 aa, Arabidopsis thaliana
MARTTRERVKSFINNRWLVFVAAMWIQSCAGIGYLFGSISPVIKSSLNYNQKQLSRLGVAKDLGDSVGFLAGTLSEILPLWAALLVGSVQNLVGYGWVWLIVTGRAPILPLWAMCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMTQSLGYDNTHVFVSMISIWNFLGRIGGGYFSELIVRDYAYPRPVAIAVAQLVMSVGHIFFAYGWPGAMHIGTLLIGLGYGAHWAIVPATASELFGLKKFGALYNFLTLANPAGSLVFSGLIASSIYDREAERQAQGSLFNPDDVLRCRGSICYFLTSLIMSGFCLI

SEQ ID NO: 5884 - protein, 405 aa, Triticum aestivum
  unsure (1)..(405): unsure at all Xaa locations
MEAQWLAEYPHQAADNRPSKRPRLAWDAAPQLFPPPKAIPMLYCGQELINGNFTTAFLPPPPIYYAGPPRNLSPPWRPDDKDGHYVFTLGENTTPRYRILSTRGAGAFGQVLECWDLENQESVAIKIVRSLQKYREAAMIEIDVLQRLGKHDFTGRRCXQIRNWFDYRNHICIVFEKLGPSLYDFLRKNAGRSFPIDLVREFARQILESVTFMHDLRLIHTDLKPENILLVSPDTIRVHDYKIPIRPPKDGSVFKNLPKSSAIKLIDFASTTFDHQDHNYVVSTRHYRAPEAILGLEWNYPCDLCRVGCILIDLCSREALFQTHENLEHLAMMKNVLCPLPKHMIARADRRAEKYFRRGLMLDCPEGAASLESMKAGWKLPHLQNLDMQHVXHSDWDLIDLLPRA

SEQ ID NO: 5885 - protein, 163 aa, Clostridium perfringens str. 13
MYKLGIITSSDKGYSGERKDESGLVIADIAKGKGFKVEKYIVLPDEREMLRDEMINMADNLGVDLILTTGGTGFSKRDVTPEATKDVIEKEALGIPEAIRSYSMTITKRAMLSRATAGIRKDTLIVNMPGSPKACREVMDYILDDLKHGIDIMKGDARECARK

SEQ ID NO: 5886 - protein, 240 aa, Triticum aestivum
SQGSSCSQHCQKDESEEIVDSINPVTVAGYREEKGTAGSTSAITAVRAPGSRSSCFHGVTRHRWSGKYEAHLWDSTCRVEGRRRKGKQVYLGSYDTEQKAARAYDVAALKFFGLNTKLNFSISEYEKELADIQDMSPEECVTYLRRRSSCFSRGASIYRGVTRRQKDGRWQARIGLIAGTRDIYLGTFKTEEEAAEAYDIAAIEIRGKNAVTNFDRSNYMDRGMHCIEGAGLKLLATKPE

SEQ ID NO: 5887 - protein, 145 aa, Triticum aestivum
  unsure (1)..(145): unsure at all Xaa locations
MXPNVMGSSGTSVAPFXGLKSXAGLPVXRRSNXANLXSVXSNGXRIRCMQVWAIXGIXKFETLSYLPTLNTEALLKQVDYLIRSKWVPCLXEFNKXGFIFREHXNASPGYYDGXRYWTMXETAYVPGCTDPHKVXKPSGRSKKEP

SEQ ID NO: 5888 - protein, 298 aa, Lactobacillus plantarum WCFS1
MKLGLIGLGKMGMNLALNMQDNGHTPVGMDLNPTNLSTASAHGLATATDLTNLLDQLPTPRIVWIMVPAGKATNSVIEQLAQTLSAGDIVLDGGNSHYQDSIRHGELLASHHINFLDVGTSGGQAGARHDGNFMIGGDLATFQVVEPLFKAIAAPDGYLYTGPVGSGHYLKMVHNGIEYGMMAAIGEGFDVLQHSQFTYDNAAVAKMWNNGSVIRSWLMGLAQDAFSKDGNLDDIKGVMHSSGEGRWTLDTALDQQVATPVIAMALMMRYRSETDDTFTGKVVAALRNEFGGHAVDHE

SEQ ID NO: 5889 - protein, 294 aa, Trichodesmium erythraeum IMS101
MTETTAKVRKAVIPAAGFGTRMFPVTKVVKKELFPIIDKDGRAKPIIQIIIEEAISGGIEEVGVVVQESDRQIFTDYFQGVPSYYEKLSPEKQEYCQYLQNLGNKITFLTQEQQAGYGHAVFCAKDWVRDEPFLLLLGDHLYTSEVTKSCTSQFLQVYEQTNKSVLGVRIIPGTEIHHYGCIGGTLVADSLINIDTIYEKPDLNYAREKLHVLGMKKEHFLGVFGIYVLTARIFDYLEENIKQNAREKGEFQLTSCLDKLQKAEGMTGYLVKGRCFDTGMPDVYWQTMIDFRNA

SEQ ID NO: 5890 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 5891 - protein, 496 aa, Novosphingobium aromaticivorans
MDGRASRNTTTLLPPAALHRGQEEGPAMATAKDILARIKDEEIEWVDLRFTDPKGKWQHLTMVSTVLGEDELEDGLMFDGSSIEGWKAINESDMILKPDLDAVYVDPFSASPMLIICCDIVEPSTGELYARDPRSTAKRAAAFVKTAGLGDTVYVGPEAEFFLFDDVKFYDGYDGNGFRIDDIELPTNSNKDIEGGNLAHRPRAKGGYFPVAPVDSCVDIRGEMVRTMLDMGLPCDKHHHEVASAQHELGLTFGTLVQTADRMQVYKYVVQQVAHAYGKTATFMPKPIKGDNGSGMHTHISIWDSGKPLFAGNGYAGLSDMCLYFIGGVIKHAKALNAFTNPTTNSYKRLVPGYEAPVLLAYSARNRSASCRIPYGAGAKAKRVEFRFPDAMANPYLCYAALLMAGIDGIKNKIHPGEAMDKNLYDLPPAELAEVPTVCGSLREALESLEADHDFLLQGGVFTKEQIESYIELKWPEVLRWETTPSAVEFDMYYSL

SEQ ID NO: 5892 - protein, 104 aa, Zea mays
VHVCLSHPLRANPHPTEFQRAVIRWMLDDGSGRPGFVAESTGHQASSRLLSMKSVNAMLEDAEVKVAILTLSDTVSSGAGPDRSGPRAVSVVNSSSEKLGGATV

SEQ ID NO: 5893 - protein, 426 aa, Oryza sativa
MASSSVRLCTSDSQLVRTYTAAARDDRPTDGDDACSMLLPPSRPLPFFTCSLTFLAIAIIGARMALEAVVFSEGYYFGCGGAMAAEAAAGGAWSWSHGYGGGVDQGKGAMELVVDDGVVNAFWDGGGGGASSSPVMAAVSGFIEEPDGGNSSVADAAPPPEHGGASVVGRDGSAAAPAAAAGRRKRRRARTVKNREEVESQRMTHIAVERNRRKQMNEYLAVLRSLMPASYVQRGDQASIIGGAINYVKEMEQLLQSLEAHRHARRARTDAAAALPFAGFFTFPQYSMSAVPTTTTTTVAAAATENGNAVAGAGAGDDADADVSGSKPSSVADIEVTMVESHANLKVLSRRRPRQLLRMVAGLQHHRLAVLHLNVASAGHMALYSLSLKVKEDCQLTSVDDIAAAVHGIVETIEQEQQQQQKQSCS

SEQ ID NO: 5894 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 5895 - protein, 253 aa, Glycine max
MMGRVMEKPSQDLLQQQQQALKCPRCESSNTKFCYYNNYSLSQPRHFCKACKRYWTRGGTLRNVPVGGGCRKNKRVKRPTNHGDSSSSAANSPSSSNSNPPSQPHIDNIIASSSTTNHINNISPFFYGGDVMSSVPFPRFNLHSQLNALGLGFSTGVSENGFSTSNNNSFFSAYNSMFGSSSSSTCAPSTPVMASLLSSTLLQQKLMSGGGGGEGEEVVIMIKVATLSMAWHRYKGCKWKGIIIIVIILAQKK

SEQ ID NO: 5896 - protein, 126 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 5897 - protein, 290 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVIQMVLYVFYMNKTPVASEVKEGKEAWKVPAEDHVVVINVGKADKSSCAEVRPVTEMAGAVDVPRRCAAEAAAAPGMDFARSVDVV

SEQ ID NO: 5898 - protein, 514 aa, Oryza sativa (japonica cultivar-group)
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 5899 - protein, 478 aa, Debaryomyces occidentalis
MVHLGPKPPQHRKGSFLDVPEYLLKELTELEGLLTVSGETLRKITDHFISELEKGLSKQGGNIPMIPGWVMDFPTGKEMGDYLAIDLGGTNLRVVLVKLGGNRDFDTTQSKFALPENMRTAKSEELWEFIAECLQKFVEEEFRNGVLSNLPLGFTFSYPASQGSINEGYLQRWTKGFDIEGVEGHDVVPMLQAAIEKRKVPIEVVALINDTTGTLVASMYTDPEAKMGLFSGTGCNGAYYDVVDNIPKLEGKVPDDIKSSSPMAINCEYGAFDNEHIILPRTKYDIQIDEESPRPGQQAFEKMISGYYLGEVLRLILLDLTSKQLIFKDQDLSKLQVPFILDTSIPARIEEDPFENLSDVQELFQEILGIQTTSPERKIIRRLAELIGERSARLSICGIAAICKKRGYKTAHCAADGSVYNKYPGFKERAAKGLRDIFQWESEEDPIVIVPAEDGLGAGAAIIAALTEKRLKDGLPLV

SEQ ID NO: 5900 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTIVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 5901 - protein, 124 aa, Zea mays
  unsure (1)..(124): unsure at all Xaa locations
MAYSMLSSAAXCYLPGSXHMVAPFTGLKSSSAFPVTGRAXXDLTLLVSNGEKVNWMEGGPQLGKKNFETLFLTFRDLYPKFKLGGGEGEKLFSPKKGGVPLGGEEIPRGGEHPFFFFGPRGETQ

SEQ ID NO: 5902 - protein, 37 aa, Oryza sativa (indica cultivar-group)
DQHYKWPYPTEDDKAKLVEETGLQLKQINNWFINQRK

SEQ ID NO: 5903 - protein, 487 aa, Mycobacterium tuberculosis H37Rv
MPPLDITDERLTREDTGYHKGLHSRQLQMIALGGAIGTGLFLGAGGRLASAGPGLFLVYGICGIFVFLILRALGELVLHRPSSGSFVSYAREFYGEKVAFVAGWMYFLNWAMTGIVDTTAIAHYCHYWRAFQPIPQWTLALIALLVVLSMNLISVRLFGELEFWASLIKVIALVTFLIVGTVFLAGRYKIDGQETGVSLWSSHGGIVPTGLLPIVLVTSGVVFAYAAIELVGIAAGETAEPAKIMPRAINSVVLRIACFYVGSTVLLALLLPYTAYKEHVSPFVTFFSKIGIDAAGSVMNLVVLTAALSSLNAGLYSTGRILRSMAINGSGPRFTAPMSKTGVPYGGILLTAGIGLLGIILNAIKPSQAFEIVLHIAATGVIAAWATIVACQLRLHRMANAGQLQRPKFRMPLSPFSGYLTLAFLAGVLILMYFDEQHGPWMIAATVIGVPALIGGWYLVRNRVTAVAHHAIDHTKSVAVVHSADPI

SEQ ID NO: 5904 - protein, 218 aa, Cytophaga hutchinsonii
MKFFIDTANLNEIREAQELGILDGVTTNPSLMAKEGISGKDNVFKHYKAICDIVDGDVSAEVIATDYKGIIEEGEELITIDPKIVVKVPMIKDGIKAIKYFSQKGIRTNCTLVFSAGQALLAAKAGATYVSPFIGRLDDISQDGMELIAQIVGIYRNYDYQTEVLAASVRHTMHLINCAEVGADVVTCPLNVITGLLNHPLTDSGLAKFLADHKKVNG

SEQ ID NO: 5905 - protein, 359 aa, Zea mays
MEEITQHFGVGASSHGHGHGQHHHHHHHHHPWASSLSAVVAPLPPQPPSAGLPLTLNTVAATGNSGGSGNPVLQLANGGGLLDACVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 5906 - protein, 366 aa, Photobacterium profundum
MTLSNLSSFFTCRVTKDSVILPPVIFHNKLSRGATVMTIKVGINGFGRIGRFVFRASVERNDIEVVGINDLIDVEYMAYMLKYDSTHGRFNGTVEVVDGNLVVNGNTVRVTAVRNPEELKWDEIGVDVVAEATGLFLTDETARKHITAGAKKVVLTGPSGDVPMFVMGVNSADYAGQDIVSNASCTTNCLAPIAKVINDKWGIESGLMTTVHATTATQKTVDGPSMKDWRGGRGASQNIIPSSTGAAKAVGKVIPELNGLLTGMAFRVPTANVSVVDLTVNLKTAATYEEICAEMKRASENEFAGVLGYTEDAVVSQDFIGEVQTSVFDAKAGVALTDKFVKLVSWYDNEIGYSNKVLDLIAHVSK

SEQ ID NO: 5907 - protein, 339 aa, Fragaria x ananassa
  unsure (1)..(339): unsure at all Xaa locations
MRPSMSLIRSVSRVARRGYSSESVPQRKVAVLGAAGGIGQPLALLMKLNPLVSQLSLYDIAGTPGVAADVSHINTRSEVKGYAGEEQLGEALEGCDVVIIPAGVPRKPGMTRDDLFNINAGIVRSLTAAIAKYCPHAIINMISNPVNSTVPIASEVLKKAGVYDEKKLFGVTTLDVVRAKTFYAGKAGVPVAEVNVPVVGGHAGITILPLFSQATPKANLSDDYIKALTKRTQDGGTEVVEAKAGKGSATLSMAYAGALFADACLXGLNGVPDVVECSYVQSSITELPFFASKVRLGKNGVEEVLDLGPLSDFEKEGLKQLKPELKSSIEKGIKFANQS

SEQ ID NO: 5908 - protein, 197 aa, Glycine max
INALCMAFYARSEEARQSHATQNFALRALALEDALSKGLPIETEIASLQSYLGSTDKDSVLDLVLASLPEETRSNGTDTQLQLKQKFDALKGSVRHFSFFPPGGGGMLAHSLAHVASWLKVREDNQSGDGIESVINKVEVYLAEGKLAEAAACLEESVRGTQAAEIVAGWVRQARNRAISEQAVLLLQSYANSLSFT

SEQ ID NO: 5909 - protein, 326 aa, GIBBERELLA ZEAE PH-1
MVSYTPLPVSSQGLAQRSTPSSLQVGLYMVAWIVSSNITILFNKWLLDTAGFIFTAILLVTWHLVFATVVTQILARTTTYLDSRHELPNSWDFYLTTVLPIGIVSSGSLVASNFVYLYLSVAVIQMLKAASPVSVMIVSWLFGVMDPTIGKIANILVIAMGVAVASAGMIEFSVIGFIFQMGGLAFEAVRVVMTQVMLNGEGLKMDAMVGLYYYAPVVAILNLLVAFMIELPHFDMADFHRVGFPTLFLNAAVAFTLNFTSMVLIGKTSGLVMSLSGIFKNILLVICSVIIWHVTITPMQLLGYSITLFSELKPFLHDSVPSPQLA

SEQ ID NO: 5910 - protein, 411 aa, Glycine max
  unsure (1)..(411): unsure at all Xaa locations
MALRLNPIPTQTFSLPQMPSLRSPRFRMASTLRSGSKEVENIKKPFTPPREVHVQVTHSMPPQKIEIFKSLEDWAEQNILTHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLFDSYSSVAQRIGVYTAKDYADILEFLVGRWKVEQLTGLSGEGRKAQEYICGLPPRIRRLEERAQARVKESSTLKFSWIHDREXTTLNAPREEHGEIFRQYRSEKC

SEQ ID NO: 5911 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVXRRMIGTDAFQETPIVEVTRSITKHNYLVMDVDDIPRIVQEAFFLATSGRPGPVLVDVPKDIQQQLAIPNWDQPMRXPGYMSRLPQPPEVSQLXQXVRLISESKXPVLYVGGGSLNSSEELGRFVELTGIPVASTLMGLGSYPCNDEXSLQMLGMHGTVYANYSVEHSDLLLAFGVRFDDRVTGKLEAXASRAKIVHIDIDSAEIGKNKTPHVSVCGDVKLALQGMNKILENRAEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 5912 - protein, 179 aa, Haemophilus somnus 129PT
MNKLELIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 5913 - protein, 498 aa, Glycine max
  unsure (1)..(498): unsure at all Xaa locations
MASLSCSANDLAPLFNDTAAANYLCAQFDSISRKLNVTTYAVDNTYLLFSXYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGSIAERTQFVAYLIYSSFLTGFVYPIVSHWFWSSDGWASATRSHGNVLFGSGVIDFAGSGVVHMVGGIAGLWGALIEGPRIGRFDRSGRSVALRGHSASLVVLGTFLLWFGCXGFNPGSFLTIAKGYESGGYYGQWSAIGRTAATTTLAGSTAALTTLFSKRLLAGHWNVIDVCNGLLGGFAAITSGCAVVEPRAATVCGFVAAWVLIGLNKLAAKVDDDDPLEAAQLHGGCGAWGVIFTALFAKKEYVSQVYGEGRAHGLFMRGGGKLLAAHVIQILVIVGWVSATMGPLFWGLNKLKLLRISSEDELAGMDLTRHGGFAYAYEDDESHKHGIQLRKVGPNASSTPTTDE

SEQ ID NO: 5914 - protein, 759 aa, Luffa cylindrica
MWRLKVADGGNDPYIYSMNNFIGRQIWEFDPNAGTPEERAEIERLRHHFTKNRHKGFPSADLLWRVQLLREKNFKQSIPAVKVGDGEEISYEMALDAMRRGAHFLAAIQASDGHWPSETSGPLFYVCPLLICMYIMGFMDKVFSPEHKKEMMRYIYNHQNEDGGWGLHVGGHSNMFCTTFNYISLRLLGEEPDVEAVCKARNWIHDHDGVTSILSWGKTWLSILNVFDWSASNPMPPEYWMLPTWVPIHPSNMMCYTRITYMPMSYLYGKRFQAPLTPLVLQLRDELHTQPYDQINWRKVRHMCATEDLYFPHPFVQDLLWDTLYLLSEPLMTRWPFNKLIRQKALNETMRHIHYEDENSRYITIGCVEKPLCMLACWVEDPNSEYVKKHLARIPDYLWMAEDGMKMQSFGSQSWDAALAMQALLSCNITREIGSVLNSGHDFIKNSQVRNNPPGDYKSMFRYMSKGSWTFSDCDHGWQVSDCTAENLKCCLLLSLLPPDIVGEKMEPERFYDAVNVILNMQSKNGGLPAWEPASSYYWMEWLNPVEFLEDLIIEHQHVECTSSALQAILLFRKQYPGHRRKEINNFINKAVQFLQDIQLPDGSWYGNWGICYTYGTWFALKALSMAGKTYENCEAVRKGANFLRKIQNPEGGFGESYLSCPYKRYIPLDGKRSNLVQTAWGMMGLICAGQADVDPTPIHRAAKLLINSQTEDGDFPQEEITGEFFKNCTLHFAAFREVFPVMALGEYCNKVPLPSKKK

SEQ ID NO: 5915 - protein, 1943 aa, Cochliobolus heterostrophus
MADDKKPTTLAPPAVTALKHEATTSPGHRHGMERTVSQDMRNERADLKEAAEHSLNIIMDLDLEGKIRYVSPSWTDVIGTLPAQVTGKPVLDLICSGADGFAQAIESVRKDDSRSHIARFTIQLGPHSILRQRRPRHSVAQGQESTPRSPTNVPDDEEQFLNVEAQGIMVYDRTTGAESHTMWMVRPSVIREVTIDLPEVLVEALGVGAEVLAHYLTGLAEQSATDPGNCAPPLPVLCRICERQITPWWFEKHSELCLQEHRAEMDVQMAQETLAEHRNAIVKVLDTLESHSQRSRPASIDSVQPLQPAEYKGLIIHSTSTPSSGSPSSTPSGRNSPASPPSRSRERSERPSGFGHHRARSFAVRRPLARIVELVLDLCDTALEINTPAVKDNTRGQSVAEIRTQSPQSENRISQVLQWQSPTTGSADHTEGLKLLCEDTSKLARAKVDAVTRHRRVLEYSERLRIEFDILVQECIEAAILKAARIAAGEDSSSEEDERQEEVQSDANDTDTATDIAPGEEGIFPCSYDPPSSMAHALRSTSDASLPARVGRRESSVAGSNRSSSPRGGCQTPRSHVGAISIATHNKRQSMHFESDTGAESDTSMRSSVLSGPRRADSPATSDVGLGRVASSRERKRKSLILPSVMSSRQQSPARTMVPPPSSPLRTTKPRLPSGVEGIHSPITSPVLQTTEFSSPAMMHTIQHHRRQSSTAGSDGPRPISPRLIASTQPQPRAVPPSIKDFEIIKPISKGAFGSVYLAKKKSTGEYYAIKVLKKADMVAKNQVTNVKAERAIMMWQGESDFVAKLYWTFSSKDYLYLVMEYLNGGDCASLIKVLGALPEDWAKKYLAEVVLGVEHLHSRGIVHRDLKPDNLLIDGKGHLKLTDFGLSRMGMIGRQKRALKSVEPAPDLLKTGPFHRATSVGSSRSASFDLNHSPSQTPAMTPALTGDIGQPSYFSLNRETSQQSRERSRRPSGTRSDSQDSDALQAMFRRFSIVDDSFSHPRGRSPIEEEALSDDGSPDPYAVPVSMSHSGLAQNSVLGPTSTMPPPPMTLFDPEDSDRRFVGTPDYLAPETIAGNGQDEVSDWWSLGCILFESLYGYPPFHADTPDEVFQNILARKIDWPADDDELYDISDEAKDLMNRLMCSDPTERLGANKDEKFASGGEEIRSHPWFADINWDTLRDDEASFIPAPENPEDTEYFDSRGAAMANFNPEFEDQATTPAGTPSTDYPDRPHDALSRVRSQVTVSTMKRGLIPLHIPAHVREGRTRRLSEPMAADDFGNFSYKNLPVLEKANKDVIQKLRAEAMLPQNKPTPPLQSPNVTSPSPSLENSPMLPGSLKRTLSTNRAPGRPSSPSVSGPHSSPSRGSQPSSPLLVQFSTGQHHDRRKTSSSSSTLSHSTSNPSTLQPGVSGMRPSPEGISPIKLPKTPSSTGTSQDKTAAGQRQTFTGSAIADSPRARSQTIGSQEEDLVHNLLPGHYKRRSQVLDVSPSSSDTEDSRAKALLRVQRRRQSSRRLSQISFGDGPFFRPLDVLICEDHPVSRLVMEKLLEKLRCRTLTVTNGSEAIRYAMGEVKFDVIMMEFRLPQVNGADVARMIRDTKNANTHTPIVAVTGYLKELQAPHYFDALIEKPPTVAKLTDTLSRLCQWKAPPPGWTPSQSFPSIMPASGLRQESSRQEDSPSSHSSGFPAVPSASYRGSSREDSISSSFFGDNDSRAGEDIPVRIHNADDWRERDMARAMGGLAIGDDAANADTKNAPSNRGGPPDLPHGDSTQPSLEEATIRRQRSTEQVGAKRRVLETRKHESAESGDDEDDELGHAPIRTRSPKSRPKSTSKLGIEMMRTNSRGSVISVEDPGQPDTTLPSSPPPMITEDRAAEEYEGNLPASGFAPSLLTPPVIFPEQPGDDVEEFVMETPKAQKETASPDPDPTPKAKNTLPKPNNASDD

SEQ ID NO: 5916 - protein, 407 aa, Triticum aestivum
  unsure (1)..(407): unsure at all Xaa locations
MDAGGAQPXPDSEMAEAGAAAAAAAAAAGAAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMEVFPCGISSLQLIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 5917 - protein, 897 aa, GIBBERELLA ZEAE PH-1
MGNFISWLEDNLPDPKSTKGNAGEARGPQPKSVSSMVSTLVPVLVASAAYILIFLILRKSNRRFYAPRTYLGSLREHERSPALPGGWFGWIGTFWKIPDAYALQHQSLDAYLFIRFLRICCTICFVSLCITWPVLFPVNATGGNGKTELELLSYSNINIQSSKERNRLYAHCFIAWIVYGFVMYTIMRECLFYVSVRQAFLLTPQYAKRISSRTVLFTSVPKDYLDEARIRTLFNDSVKNVWIPGETKEVDEIIEERDEVAMKLEKGEVKLLKLCNKERIKSMKKSGAEAEKQNSGPTDPETGDLAARWIPQKKRPTHRTGPLGLIGKKVDTIEWGREELKTLIPKADEAQANWLAGNYEKHSAVFVEFYTQSDAQAAFQTTTHHHALHMAPRHIGVKPDEVVWNSLKFPWWQIVIRRYIIAAIIAILIIFWAIPVAIVGIIAQVNTIKTLPGLTWIESIPSVILGVISGLLPSVALSILMAMVPIFMRVCAKQAGCVSISQAELYTQNTYFVFLVLQVFLVQTLANSFVSSIVTIVQDPSQVFTMLSSSIPTASNFYISYFIVQGLGIATSVLTQVVGCVIFNLLYKFLASTPRAMYNKWTTLSALTWGSLMPVYTNIAVISIVYAVIAPLMLFWSTLGMALFYLAYRYNILFVTETKIDTRGLIYPRALKQLFVGVYLAEVCLIGMFIVSKAAGPAALMVIFLIFSILFHMTMAKALNPLLYNLPRSLEVEEERIQQSAQGSELEDGQVLNNNGVTNATTNGVENGDAKSTRVGKFVPGGVGGVQKKGNFFSKWLKPWIYADYATMRQLVPHESTMGLDYTEQVERDAYFPPSITSETPILWIPADPAGISKQEVLHTSKVIPISDEGCTLNDKNNIEWDTEGARPPIWTEKIYY

SEQ ID NO: 5918 - protein, 504 aa, Azotobacter vinelandii
MPRAAPTPCASCAWATSSIERRGLRCNRANLRTGRATSTSAPRMPNNRSCSPRARPFRPLHRTRHTMSNPSTSIQHVAAREILDSRGNPTVEAVVTLAGGATGVASVPSGASTGSREALELRDGALRYQGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCRGR

SEQ ID NO: 5919 - protein, 343 aa, Chrysosplenium americanum
MLFAMQLASASVLPMVLKSAIELDLLEIIRGQDTCMSPTEIASHLPTTNPDAPAMVDRILRLLSCYSVVTCSVRSVDDQRVYGLAPVCKYLTKNQDGVSIAALCLMNQDKVLMESWYHLKDAVLDGGIPFNKAYGMSSFEYHGTDPRFNKVFNRGMSDHSTITMKKVFQAYQGFQGLTSLVDVGGGTGATLTMILSKYPTIRCINFDLPHVIEDAPEYPGIEHVGGDMFVSVPKGDAIFMKWICHDWSDEHCLKLLKNCYDALPNNGKVILAECILPEVPDSSLATKGVVHIDVITVAHNPGGKERTEKEFEALAKAAGFQGFQVFCNAFNTYIIEFSKQICN

SEQ ID NO: 5920 - protein, 419 aa, Oryza sativa
MENMRSENFNQGVSMEGVKHAPEMANTNRRALRDIKNIIGAPHQHMAVSKRGLLDKPAAKNQSGHRPMTRKFAATLANQPSIAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 5921 - protein, 676 aa, Populus nigra
MDLQASVVTFVSFLILALSQAQNLQPFHREYGPFNETYYDIFQVERPATISNNALQITPDSINGNFTLANRSGRVLLNKSFILWEDDGAGGVRVASFNSSFVINIFRVNNSTPGEGLAFLIAPDLALPENSDGQYLGLTNSTTDRNPENGIVAIELDTVKQEFDPDDNHMGLNIHSVISLKTVSLDDLGIEIAPVGARNHMVWVHYDGNSKKMEVYMAEEGRAKPATPALAAELNLKDLVREKSYFGFAASTGRNFQLNCVLKWNLTVEMLSDDSVENGGNDNKKLIKICVGIGVGLFSLLLIGVGTWLYYLHKKKAASDPNLLGALKSLPGTPREFPFKDLKKATNNFDERHKLGQGGFGVVYKGLLTKENIQIAVKKFSRENIKGQDDFLSELTIINRLRHKHLVRLLGWCHRNGMLLLVYDYMPNGSLDNHLFHELEGNVILEWNLRYKIISGVASALHYLHNEYDQTVVHRDLKASNIMLDSEFNARLGDFGLARALENEKTSYAELEGVPGTMGYIAPECFHTGKATRESDVYGFGAVVLEVVCGQRPWTKIGGFQFLVDWVWSLHREERILEAVDERLNSDYVAEEAKRLLLLGLACSHPIASERPKTQAIFQIISGSVPPPHVPLFKPAFVWPAAVGNIDVDASSADTIPITSGWTPQYISRESFGTGE

SEQ ID NO: 5922 - protein, 349 aa, GIBBERELLA ZEAE PH-1
MSPLWVRRLCIRVVDSLYGSFLYLPLAILFLKRSVTGFGTGEWDESQIPKLDGKVAVVTGGNAGIGYYTVKHLASRGAKVYLGARSESRAKAAIKRLLEENPLIPQENVVWLRLDLANQSQVVDAAVELQSKEQRLDILVNNAGIDPYDYIRTADGFEMTMAVKYTNPAAAAQEESDVRVITVSSSGEAYSSPTNQFTSPKDLDDPCASPGWENSCLGQAMRYGTTKLANVLFASELQRRMDEEDANIISLSLNPGTVRTDGAANVMPFMVRPLVRFLFTAPERGADTSLFAATAEEIKENSERWKGRYLDGPGRIKVPSLRARDAVAGRNLWNITEAAVRGTGALDRL

SEQ ID NO: 5923 - protein, 156 aa, Ananas comosus
MSLVRRSNIFDPFSLDLWEPFEGFPFGGALSFPRPSASFPAETASFAGARIDWKETPEAHVFKADLPGVKKEEVKVEVEEGNVLQISGERTREKEEKNDTWHRVERSSGKFLRRFRLPDNAKVDQVKAAMENGVLTVTVPKEDVKKPQVKSVQISG

SEQ ID NO: 5924 - protein, 525 aa, Pichia pastoris
MTIQYTPKVQVNTDKARYTENELLTDYTYENTIVEKQADGTYNVTPTSLDFEFKVDLKTPKTGLLLVGLGGNNGTTLVGSVLANKHNISFETKTGIQQPNYYGSVTQASTVKLGIDSNGRDVYAPFNSLLPLVHPNDFVVGGWDISGLDLASSMRRSQVLQPDLVRKLEPYMKDIVPLPSVYYPDFIAANQNERADNCFNREGKDGEVSTKGKWSHVERIRSDIAEFKQKNDLDKVIVLWTANTERYAELIPGVNDTAENLIKAIKNDHEEVSASTIFAVACILDKIPYINGSPQNTFVPGCIELAETEGSFIGGDDFKSGQTKLKSVLAQFLVDAGIRPVSIASYNHLGNNDGYNLSAPQQFRSKEISKASVVDDMIESNEILYNEKNGNTIDHCIVIKYMKAVGDDKVAMDEYHSELMLGGHNTISIHNICEDSLLATPLIIDLVVMAEFLSRVSYKKKGDAEYESLHSVLSFLSYWLKAPLTRPGYQAINGLNKQRAGLDNFLRMLIGLPTQNELRFEERLQ

SEQ ID NO: 5925 - protein, 359 aa, Oryza sativa (japonica cultivar-group)
MVRWRRWICCNCQVNESDQLENGHAKVLTSNADGVTKGLKDSATEKAQPQNSALTINIPVLSLDELVEKTDDFGSSALIGEGSYGRVYYAVLDSGTKIAVKKLDSNENEPTSEFLTQVALVSRLKHENFVDMLGYCTEGNLRLVAYEFATMGSLHDVLHGRKGVQGAQPGPALDWMQRVRIAVDAAKGLEYLHEKVQPSIVHRDIRSSNILLFEDFKAKVADFNLSNQAPDMAARLHSTRVLGTFGYHAPEYAMTGQLTQKSDVYSFGVVLLELLTGRKPVDHTMPRGQQSLVTWATPRLTEDKVKQCIDPRLNGEYPPKGVAKLAAVAALCVQYEAEFRPNMSIVVKALSPLLTTLDG

SEQ ID NO: 5926 - protein, 464 aa, Kappaphycus cottonii
KMGYWDPQYVVKDTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPVLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 5927 - protein, 418 aa, Oryza sativa (japonica cultivar-group)
MGAEAKAPLLEGRRGATPAQTLGNIVVSIVGTGVLGLPYAFRTSGWLAGALGVAGAGAATFYCMLLLLDCRDKLREQEEVDHDGNYTYGDLGEKCFGAIGRYFTEVTIILSQTGGSVAYLVFIGQNICSVFPTTAAGGEEPPRRVSPAAVVLAVLLPAEAALSFIRSLSSLAPFSILADACTVLAVATVVREDVQLLAGRGGSPFQGRSALAGLWGVPFACGVAVFCFEGFCLTLALEASMSDRRRFRPVLLHAIAGVTAVYVCFGVCGYLAYGDVTRDIVTLNLPNNWSTAAVKIVLCVALALTFPVMMHPIHEIVEARLFPSAGGWARKRAAVQASRVAVVGAVTAVACFVPAFGEFAAFVGSTVCALLSFVLPALFHLRLVGAAASAWRRAVDGGFLLLGLAFAAHGLYTVVSGL

SEQ ID NO: 5928 - protein, 169 aa, Glycine max
ALDVAKTQCYHFTAIVIAGMGFFTDAYDLFCISLVTKLLGRIYYFEGHDKPGSLPSNVSAAINGVAFCGTLAGQLFFGWLGDKMGRKRVYGMTLMLMVICSIASGLSFGKDPKAVMATLCFFRFWLGFGIGGDYPLSATIMSEYANRKTRGAFIAAVFAMQGFGILAGG

SEQ ID NO: 5929 - protein, 199 aa, Nitrosomonas europaea
MLLMIDNYDSFTYNLVQYLGELGEEVMVVRNDEITLEAVQQLNPASVVISPGPCTPDEAGISVELINRFSGKIPILGVCLGHQSIGQAFGGRIVRAGKVMHGKTSLVFHDGKGVFQGMPDPFVATRYHSLVIERSSIPDCLEISAWTEDGEIMGVPHRALPVEGVQFHPESVLSEHGHLLLDNFLHGNSVQKHSSMCEA

SEQ ID NO: 5930 - protein, 343 aa, Oryza sativa
  unsure (1)..(343): unsure at all Xaa locations
MDAGSRSSGGAGFDDDDGHAARREVSSSLKELTVRVEGKGGSCSGSAGTDQMPNTPRSKHSATEQRRRSKINDRFQLLRDLLPHNDQKRDKASFLLEVIEYIRFLQEKVQKYEVSYPEWNQENAKVVPWTNIYFRSSWKNAQNKGQVPADHSPDPPELLKNGSPYMFPFTGNSDNNNAVETAAASGAQDQAETDPMSRVSYRSVDTPSPNNVADKVTSQPHAQLVRPSPAENHTVNCDKLNNSDLAIDEGTISLSSQYSQELLNKLNHALXNSGIDLSQASXCSVQINLGKRAMKRSTPAATSTSKELTDPASNSQAMGRQLRLGDGAEEHRQASKRHKSDNS

SEQ ID NO: 5931 - protein, 244 aa, Zea perennis
SIRNNPVQNKVMNGEDPINNNHAQTAGLGVRLATSSSSRDPSPSDEDMDGEVEILGFKMPTEERVRKRKESNRESARRSRYRKAAHLKELEDQVAQLKAENSCLLRRIAALNHKYNDANVDNRVLRADMETLRAKVKMGEDSLKRVIEMSSSSVPSSMPISAPTPSSDAPVPVPPPIRDSIVGYFSAPSADDDASVGNGFLRLQAQEPASMIVGGTTLSATEMNRVAAATHCAGAMELIQTAMG

SEQ ID NO: 5932 - protein, 142 aa, Triticum aestivum
  unsure (1)..(142): unsure at all Xaa locations
MAPTVMASSATSVAPFQGLKSTAGLPVSRRSNGASLGSVSNGGRIRCMQVWPIEGIKXFETLSYLPPLNTEASSSKFDYLIXRFKWVPCLEFNKSGHLPXEHNAXPGYNNGRYWXTMWKLPKFRXAPTQQVINKVEEXXKDT

SEQ ID NO: 5933 - protein, 888 aa, Xanthomonas campestris pv. campestris str. ATCC 33913
MSLSVFPHRLALALGFALAAPLTSAPAQAAAPTGTPEQRAAALVAQMSREEKVAQAMNAAPAIPRLGIPAYEWWSEGLHGIARNGYATVFPQAIGLAASWNTQLMQQVGTVVSTEARAKFNQAGGPGKDHKRYAGLTIWSPNINIFRDPRWGRGMETYGEDPFLTGQLAVGFIRGLQGDDLEHPRTIATPKHIAVHSGPEPGRHGFDVDVSPRDVEATYTPAFRAALVEGQAGSVMCAYNSLHGTPACAADWLLNGRVRGDWGFKGFVVSDCDAVDDMTQFHYFRPDNAGSSAASLKAGHDLNCGTAYRALGTAIERGEVDEALLDQSLVRLFAARYRLGELQAPRKDRYARLGAKDIDNAGNRALALQAAAESIVLLKNANATLPLKAGTRLAVIGPNADALAALEANYQGTSSQPVTPLLGLRQRFGAQQVRYAQGAPLAAGVPGMIPETALRSDGKPGLRGEYFDNVELEGAPRVTRQDRAISFNWDQVSPAKGVPADRYAVRWSGELLPPGTGDYTLAVRVARCFDCTGHDPVRLYIDDKLVVAGNAEDKHVPAGMHNADGRSVETVLHFDDTRPRKIRLELEHRGQDQGVRLEWLAPAAAQLAEAEQAVAQADAVVAFVGLSPDVEGEELRIDVPGFDGGDRNDIALPAAQQALLERAKASGKPLVVVLMSGSAVALNWAKTHADAIVAAWYPGQSGGTAIARALAGDDNPGGRLPVTFYRSTKDLPPYVSYDMKGRTYRYFKGEALFPFGYGLSYTSFAYDAPQLSSTTLQAGSPLQVTTTVRNTGTRAGDEVAQVYLQYPDRPQSPLRSLVGFQRVHLQPGEQRTLTFTLDARALSDVDRTGTRAVEAGDYRLFVGGGQPDTGAPGQSVALTIQGRAPLPK

SEQ ID NO: 5934 - protein, 581 aa, Pseudomonas putida KT2440
MAAEGNAGLLLGVITLLSAAVVAVPLLKRIGFGSVLGYLLAGMMIGPFGLQLVNDPHTIIDVGELGVVMFLFVIGLELNPSHLWALRAQIFGLGSLQVLICAVLLTVVGKAFGFPWQVSFVCAAGFVLTSTAIVMQVLSERGDLTEPRGQRIVSILLFEDLLIVPLLAVVAFLAPTAAVPEPTSPLWQRMAIAAVSLSALVIIGLWLLNPLFRVLAQARAREVMTAAALLVVLGAALLMEIGGLSMAMGAFVAGVLLSESTFRHQLEVDIEPFRGLLLGLFFLGVGMALDLQVVARNWLLISSGVLALMVVKALCIYGVARLAKSQHGDALDRAVLMAQGGEFAFVLFTEALKLKVVSAEINANMTAIVVLSMALTPVNLLLLKRFARPRAVSMDGVEPAQNLQGHVLIIGFGRVGQIACQAPLAHGAKLSIIDMDPEVIRAVEPYGFKVYYGDGARHDLLHAAGARHARTIIVCVNDKKAATRIVESTRQYCPQVKVLVRAFDREHALELVKHDADYIVRETFESSLLLGRQAVLTLGASSVEADAVTDEVRTRCRTFCPGNIRRSICRASVGSGKYRAH

SEQ ID NO: 5935 - protein, 366 aa, Nicotiana tomentosiformis
NQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMESKELFEWVLKQPCFEKTSFMLFLNKFDIFEQKALKVPLNVCEWFKDYQSVSTGKQEIEHAYEFVKKKFEESYFQCTAPDRVDRVFKIYRTTALDQKLVKRTFKLVDETLRRRN

SEQ ID NO: 5936 - protein, 434 aa, Streptococcus thermophilus
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAAARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 5937 - protein, 488 aa, Chordaria flagelliformis
MPEDVQNRTRIKSERYESGVIPYAKMGYWDADYNVKETDILALFRITPHPGVDPVEAAAAVAGESSTATCTVVWTDLLTACDIYRPKAYRVDPVPGTSDQFLAYIAYECDLFEEGSLANLTASIIGNVLGFKAVKPLRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTMGHPDGIQSGATANRVALESMVLARNEGRDYVGEGPEILRRAATTCGPLKAALDLWKDITFDYTSTDTPDFVEVATESR

SEQ ID NO: 5938 - protein, 620 aa, Ralstonia metallidurans
MLHQRRRHRTRFRASDPGGHGRHQRADSGADGVAFVRWLEALAVRRSPRLRRGRCALLHTLQERDATLAGQHRQGCGVHDAGGEVTASAHGDCRLDRASLRGRPFFWRVSFASIMPPFRWRRCRSKDAQPRPPADSAQPIVLTRTFCRSRAMSLFRTKNIDAMLEVSEHDGLRKVLGAVDLVLMGIGAIIGTGIFVLTGTGALTAGPALTVSFVIAAMACGFAALCYAEFASAIPVSGSIYTYSYATLGEIVAWMIGWDLLLEYGLATSAVSVGWSGYFQSLIAGFGIHLPTVLTAAPGAVPGEHTLFNLPACLIMLAITWIVSYGVKESARLNNVMVAIKIGVVLLFIAVGVWHVKPANWQPFAPFGMTGVFNAAALVFFAFIGFDAVTSAAEEVRNPRRDLPIGIIGSLAVCTILYVTVAAIMTGIVPFMKFEGVDHPVSLALQYAGQNWVAGFVDLGAILGMTTVILVMTYGQTRIIFAMSRDGLLPEALSTVHPVHATPYTATWTVGIVFAAIAAFVPLNVLAELINIGTLAAFTLISIAILVLRRTRPDLRRGFRCPGVPVVPLLAVGFCLFLMAHLQALTWIAFLCWIGLGLIIYFAYSRRNAVLHNHGGDAEG

SEQ ID NO: 5939 - protein, 451 aa, Pisum sativum
MATHAALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 5940 - protein, 161 aa, Oryza glumipatula
MEELEGHRGAGRLPPPPPLLPFPKVSVQVYTVPSSSTSASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 5941 - protein, 360 aa, Lolium perenne
MGSTAADMAASADEDVALFALQLASSSVLPMTLKNAIELGLLEILVAAGGKSLTPTEVAAKLPSAVNPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPANGKVVLVECILPVNPEANPSSQGVFHVDMIMLAHNPGGRERYEREFQALARGAGFTGVKSTYIYANAWAIEFTK

SEQ ID NO: 5942 - protein, 343 aa, Streptomyces coelicolor A3(2)
MPIATPEVYNEMLDRAKAGKFAYPAINVTSSQTLHAALRGFAEAESDGIVQISTGGAEFLGGQHNKDMVTGAVALAEFAHIVAEKYDVTVALHTDHCPKDKLDGYVRPLIAVSEERVKAGRNPLFQSHMWDGSAETLADNLSIAQELLARARAARIILEVEITPTGGEEDGVSHEINDSLYTTVDDAVRTVEALGLGEKGRYLLAASFGNVHGVYKPGNVVLRPELLKELNEGIASKYGQPAGSKPFDFVFHGGSGSTAEEIATALENGVVKMNIDTDTQYAFTRPVVDHMFRNYDGVLKVDGEVGNKKTYDPRTWGKLAEAGMAARVVEACGHLRSAGQKIK

SEQ ID NO: 5943 - protein, 109 aa, Oryza sativa
PGSVNSGFFSHGDTALFFPLMDSLLGQDPYLVFADFQAYVDCQNQVGEAYKDQENWARMAILNVARMGKFSSDRTIREYAEDIWAIKPVVIELEDLCPDGQCLLISPNK

SEQ ID NO: 5944 - protein, 324 aa, Lactobacillus plantarum WCFS1
MKKILVLHTGGTIAMSADESGNVTPGDENPLDNYQSSFGTDIELETEDVFNVPSPHITPARMLQLKQRIDKAAHEGVDGVVVTHGTDTLEETAYFLDLTLPNELPVVITGAMRSANEIGSDGLHNLETAIQTASTPDAAEKGVLVVMNDEIHSARYVTKTHTTNVATFRTPTFGPIGLVANKGIVFFESLLRSTVCPIQTVTDNVFLIKAYAGMGPELFDAIAQPTTHGVVIEALGAGNLPPATLPAVQKLLDMQIPVVLVSRCFNGIAQDVYAYEGGGVQLKQMGVIFCQGLNGQKARIKLLVGVSAGMSTDELARFVATANS

SEQ ID NO: 5945 - protein, 256 aa, Glycine max
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQKEIIRYLYNHQNEDGGWGLHIESHSTMFGSALSYIALRILGEGPEDGEDRAMARGRKWILDHGGLEAIPSWGKFWVTVLGVYEWSGCNPLPPELLFGYKKKKKKKKKKKK

SEQ ID NO: 5946 - protein, 779 aa, Betula platyphylla
MWRLKIADGGSDPYIYSTNNFVGRQTWEFDPQAGSPQERAEVEEARRNFYDNRYQVKPSGDLLWRMQFLKEKNFKQTIPPVKVEDGEEITYEKSTAALRRAVHFYSALQASDGHWPAENAGPLFFLPPLVMCMYITGHLNTVFPAEHQKEILRYIYYHQNEDGGWGLHIEGHSTMFCTALSYICMRILGEGPDGGQDNACARARKWILDHGGVTHMPSWGKTWLSILGIFEWIGSNPMPPEFWILPSFLPMHPAKMWCYCRMVYMPMSYLYGKRFVGPITPLILQLREELYTQPYHQVNWKKVRHLCAKEDIYYPHPLIQDLLWDSLYIFTEPLLTRWPFNKLVREKALQVTMKHIHYEDENSRYITIGCVEKVLCMLACWVEDPNGDYFKKHIARIPDYIWVAEDGIKMQSFGSQEWDTGFAIQALLASNLTDEIGPTLARGHDFIKKSQVKDNPSGDFESMHRHISKGSWTFSDQDHGWQVSDCTAEGLKCCLLFSIMPPEIVGEKMEPEQLYDSVNVLLSLQSKNGGLAAWEPAGAQEWLELLNSTEFFADIVIEHEYIECTASAMQTLVLFKKLYPGHRKKEIENFIKNAAQFLQVIQMPDGSWYGNWGVCFTYGTWFALGGLAAVGKTYNNCLAVRRAVDFLLRAQRDNGGWGESYLSCPKKEYVPLEGNKSNLVHTAWAMMGLIHAGQAERDPTPLHRAAKLIINSQLEDGDFPQQEITGVFMKNCMLHYAAYKNIYPLWALAEYRKHVPLPLGKNLNQVVNCIGQSLYKKYK

SEQ ID NO: 5947 - protein, 217 aa, Clostridium perfringens str. 13
MVKIAPSILSADFSILGEQVKRVEKGGAEFLHIDVMDGHFVPNISFGFPIMKAIRNLSNLVFDVHLMIEEPGRYVDEFISAGADLITVHYEADRHIDRTINYIKSKGCKAGIALNPGTPVSMLKNLIPSLDMVLIMSVNPGFGGQSFIPYSLDKIKEVKEMAKACGKEDLLIQVDGGVGANNIKEIVEAGANVLVAGSAVFKEDKIEENIKALREAL

SEQ ID NO: 5948 - protein, 512 aa, Triticum aestivum
MAAATSPAVAFSGATAAAMPKPARHPLPRHQPVSRRALPARVVRCCAASPAATSAAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPIWDTPMSLPGYIARLLKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALHGLNALLNGSKAQQGLDFGPWHKELDQQKREFPLGFKTFGEAIPPQYAIQVLDELTKGEAIIATGVGQHQMWAAQYYTYKRPRQWLSNTSGNDRLPFCQLIQYLDSILRRDGLAKSLES

SEQ ID NO: 5949 - protein, 589 aa, Populus balsamifera subsp. trichocarpa X Populus deltoides
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLIGGSLADHTFLFLGAGEAGTGIAELIALEMSRRSKTPLEETRKKIWLTDSKGLIVSSRKESLQHFKKPWAHEHEPVKGLLEVVKAIKPLVLIGTSGVGKTFTKEVIEAMASFNEKPLILALSNPTSQSECTAEEAYTWGKGKAIFASGSPFDPVEYEGKVFVPGQSNNAYIFPGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 5950 - protein, 329 aa, Neisseria meningitidis Z2491
MKQKIFVLYTGGTIGMTQSSEGLRPDTALVGQALAPFSNGMDFDWHVCGTLIDSSAVQLQNWCAWLDIIAAALPQYDGVLVLHGTDTLAYTANLFALALQGLDKPIVLTGSQWPYNAVGSDAPRNLATAVAAFPLGLKQTLIAFDGKLYPAVGSSKVSTETAAGFDNPHFGVIAEWDETQGWYNLRIPSQDAAAVSDGLKIRYPDPQAKIAVRTLIPGFAVQELADGLGQLPAQALILQSYGHGNTPADEGFIRAVQDFTQQGKLLLNISQVRQGRTAAVYAQGNAFRNSGIINGGKCNLETATALMTLAVSQGWGKEEVEKELARLKL

SEQ ID NO: 5951 - protein, 472 aa, Chaetoceros gracilis
DRYESGVIPYAKMGYWDASYSVKATDVLALFRITPQAGVDPVEAAAAVAGESSTATWTVVWTDLLTACERYRAKAYRVDPVPNTTDQYFAFIAYECDLFEEGSLANLTASIIGNVFGFKAVSALRLEDMRIPHSYLKTFQGPATGIVVERERLNKYGIPLLGATVKPKLGLSGKNYGRVVFEGLKGGLDFLKDDENINSQPFMRWRERFLYCMEGINRASATTGEVKGSYLNVTAATMEEVYKRAEYAKQVGSVIIMIDLVMGYTAIQSIAIWARENDMILHLHRAGNSTYARQKNHGYNFRVICKWMRMSGVDHIHAGTVVGKLEGDPLMIKGFYDTLRLTNLKVNLPYGIFFEMDWASLRKCMPDASGGIHCGQMHQLLYYLGDDVVLQFGGGTIGHPDGIQAGATANRVALEAMVLARNEGADYFNPQVGPVILRDAAKSCGPLQTALDLWKDISFNYTSTDTADFAET

SEQ ID NO: 5952 - protein, 274 aa, Schizosaccharomyces pombe
MAFGSKILNIGSKSDEYNDDAVPLDQVEEGAQERRYYLGLTKREFKLMMLAGVGFFLDSYDLFIINLVTPIFEYLYWGGIEKGPTGKGHYPSGIRGLVNASANIGNIFGQLLFGFMGDFFGRKFVYGKEMVIVIIATVLVIAMPKSIHSPLSKMMWVFCWRWLLGVGIGGDYPMSAAITSERSKIKRRGTLISLIFAFQGFGTLAGAIVTIILLGCFEHPLNREGHYHKLEGVWRLQFGLALVPAIGVLIPRLIMKESKSYENSKALNSAEGKD

SEQ ID NO: 5953 - protein, 428 aa, Triticum aestivum
MLPQQSQAAAMMQQAAAMQSMYAMPPPPHHHHLLGAAPPQQIEPILTGNLPPGFDTSTCRSVYVGNIHVQVTEALLREVFQSAGSVDGCKLIRKEKSSYGFVDYYERGSAALAILTLNRKQIFGQPIRVNWAYASGQREDTTDHFHIFVGDLSPEVTDSALFAFFSAYSPNCSDARVMWDQKTGRSRGYGFVSFRNQQDAQSAINDLNGQWLGNRQIRCNWATKGANSGEDQLTSDSKSIADVNNNFTENAKQKSNEDAPENNPLYRTVYVGNLAHEVTQDVLHRFFHALGAGAIEEVRVQHGKGFGFVKYSNHAETALAIQTGNGRILGGKPVKCSWGNKPTPPGTTSAPLPPPAAPSHPAAADLVAYQRAIEMSKMASTQALMQAQHLRQAAMGMGVGASQAMYDGTFQNVGTSQQQQQQQQLMYY

SEQ ID NO: 5954 - protein, 199 aa, Zea mays
  unsure (1)..(199): unsure at all Xaa locations
MASSMLSSAAVVTSPAQATMVAPFTGLKSSAAFPVTRKANNDITSIASNGGRVSCMKVWPPVGKKKFETLSXYXXDXXEVEWVKEXXYLLPHKWIPLCEFXXEHGFVYREHGNTPEYYNARTGHGGTSLGPMTDFAQGLKEAKRAKGKPNPFLGTSIPKNRKAGDNFYPKNPKFPGGKFERNPKKTPPIYSQGGFFPRG

SEQ ID NO: 5955 - protein, 474 aa, Anabaena sp.
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNLIHPGEPLDKNIYELSPEELAKVPSTPGSLELALEALENDHAFLTDTGVFTEDFIQNWIDYKLANEVKQMQLRPHPYEFSIYYDV

SEQ ID NO: 5956 - protein, 151 aa, Zea mays
  unsure (1)..(151): unsure at all Xaa locations
MAAAALIRRLPAARAQAQAPAFMAARPISDSTAAFTIETSVPFTSHLVDPPSRDVTTTPAELIATDSLYKAKLIRGFCHLYDDQKPVAVGMEPAITRSDSIITAYRDHCTYLARGGDLVXAFSELMGREXAGCSRGKGGSMHFYKKDANFY

SEQ ID NO: 5957 - protein, 347 aa, Lycopersicon esculentum
MAGESISGNLKDLSLNRNGAVSKKSHLVVCFGEMLIDFIPTVAGVSLAEAPAFEKAPGGAPANVAVCISKLGGSSAFIGKVGDDEFGRMLADILKQNNVDNSGMRFDHDARTALAFITLTAEGEREFVFFRNPSADMLLRESELDVDLIKKATIFHYGSISLIDEPCRSTHLAAMDIAKRSGSILSYDPNLRLPLWPSEDAARSGIMSVWNLADIIKISEDEISFLTGADDPNDDEVVLKRLFHPNLKLLLVTEGSAGCRYYTKEFKGRVNSIKVKAVDTTGAGDAFTGGVLKCLASDASLYQDEKRLREAIFFANVCAALTVTGRGGIPSLPTQDAVRQTLAEVTA

SEQ ID NO: 5958 - protein, 163 aa, Glycine max
  unsure (1)..(163): unsure at all Xaa locations
LTRYGSWGICYIYGTWFGIKGLIDAGKSYQDSQSIRRGCEFLLSKQQLCGGWGESYIACQQKVYTNLEGNKSHVVNTAWAMLALIEAGQGQRDPTPLHRAAKVLINSQMENGEFPQQEITGVFNKHCTISYSAYRNIXXPIWALGEYRSRVLLCPSKGSTAIA

SEQ ID NO: 5959 - protein, 568 aa, Arabidopsis thaliana
MDTARAWLKKLKSKGKEKSSNKKETSRGNVKEGSKTAGGEEAVSNVTKQKAAAAKQYIENHYKKQVQSQQQRKERRDMLENKLAAAEVSEEEQKNLLKDLEKKETEYMRRQRHKMGTDDFEPLTMIGKGAFGEVRICREKTTGNVYAMKKLKKSEMLRRGQVEHVKAERNLLAEVDSNCIVKLYCSFQDEEYLYLIMEYLPGGDMMTLLMRKDTLTEDEARFYVGETVLAIESIHKHNYIHRDIKPDNLLLDRSGHMKLSDFGLCKPLDCSILQEKDFVVAHNLSGALQSDGRPVAPRRTRSQMEQLQNWQRNRRMLAYSTVGTPDYIAPEVLLKKGYGMECDWWSLGAIMYEMLVGFPPFYSDEPMTTCRKIVNWKNYLKFPDEVRLSPEAKDLICRLLCNVEQRIGTKGANEIKEHPWFSGVEWEKLYQMKAAFIPQVNDELDTQNFEKFEETDKQVPKTPKSGPWRKMLSSKDINFVGYTYKNVEIVNHDQLPGIAELKKKSTKPKRPSIKSLFEDESASSTTSHQGSFMKLLPTQIEVPEKEDKSSSSSETLSSSTTRFDNATS

SEQ ID NO: 5960 - protein, 267 aa, Glycine max
MEGSVLERLDFGKMGYGCKHYRRRCRIRAPCCNELYFCRHCHNEATSMLSNPFDRHELVRQDVQHVVCSVCDTEQPVAQVCTNCGVRMGEYFCNICKFFDDDTGKKQFHCDDCGICRLGGRENYSHCSKCGCCYSNTLRDNHLCVENSMRHHCPICYEYLFDSLKDIAVMKCGHTMHSECYLEMLKRDKYCCPICSKSVMDMSRAWKRIDEEIEATVMPDDYRYRKVWILCNDCNDTTEVYFHILGQKCGHCSSYNTRAIAPPVLSQ

SEQ ID NO: 5961 - protein, 461 aa, Glycine max
  unsure (1)..(461): unsure at all Xaa locations
MATHAASSVLQRIPTNTKFSHPRSCTLLSQHQCASKQRLEVTEFSGLRSHFMVSQYXNSARRNLPFFDLGSXNCTPKQTNGSSTPVRGETVAKLKVAINGFGRIGRNFLRCWHGRKDSPLEVVVVNDSGXGVKNASHLLKYDSMXLGTFKADVKILDNETXTVDGKSIKVVSSRAPFKFPWVELGIYIVIEGTGVFVDGPGAGKHIQAGAKKVIITAPAKGADIPTDVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAPKAGSGDPLEDFCETNPADEECKVYE

SEQ ID NO: 5962 - protein, 136 aa, Zea mays
MASVGGAVAGGVGAPTPHVLAVDDSSVDRAIIAAILRSSRFRVTAVESGKRALELLGTEPNVSMIITDYCMPEMTGYELLKKVKESSKLKQIPVVIMSSENVSTRIRRCLEEGAEDFLVKPVRASDVSRVFSRVLR

SEQ ID NO: 5963 - protein, 332 aa, Magnetospirillum magnetotacticum
MTVRVGINGFGRIGRMVFRAVAKEFPEIEIVGINDLLEPDYLAYMLKYDSVHGRFAGDISVEGSNLIVNGKKVRLTAVKDPAELKWDEVKADIVIESTGLFLDAVNAEKHIKAGAKKVLMSAPSKDDTPMFVYGVNHEKYAGEKIVSAASCTTNCLAPVAKVLNDNWGIKRGLMTTVHAATATQKTVDGPSQKDWRGGRGILENIIPSSTGAAKAVGKVLPELNKKLTGMAFRVPTSDVSVVDLTVELNKDASYEDICKAMKAASEGALKGVLGYTEDKVVATDFVGCNMPSIFDADAGIALDSTFVKVVTWYDNEYGYTCNMLRFLRHIAK

SEQ ID NO: 5964 - protein, 388 aa, Salmonella enterica subsp. VII
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTRRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 5965 - protein, 177 aa, Zea mays
MGGCDRLPGSDRSVRRPGLDLPARHSRRHIPHRPLFHLVSAVGQSYGTTTCIQKACKFLLAKQLKNGGWGESHLSSTTKAYTNLDKEKSHIVNTAWAMLALMKAGQAERDPTPLHKAARLIMSMQLSNGDFPQEEMIGSFLKNGPLCYMAYRNIFPIWALGEYQKLVLQCDLQWPTF

SEQ ID NO: 5966 - protein, 248 aa, Zea mays
MAPPRRPSMGRQKIEIRRIESDEARQVCFSKRRAGLFKKASELSILCGADVAAVVFSPAGKAFSFGHPSVESVVERFLASSSPSPAGAGAGHSASGGEDRAVSELNRQHGELRAQLDAVKARQERADEAIRKEREAGSPAMAWIDAELSGGAMGHDDLVAFWAALAGVQAAVAASADRLLRDALLVGRRGRQQQQPAQLAGGGGVAFDVGAFGGVGVQVQPPPGFAGVVDLQGFGGQAAAILGAGGPS

SEQ ID NO: 5967 - protein, 556 aa, Suaeda maritima subsp. salsa
MLSQLSSFFASKMDMVSTSDHASVVSMNLFVALLRGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLHMVGRAAFVFPFAFLMNLSKKSNSEKVTFNQQIVIWWAGLMKSAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSITNFVTENIS

SEQ ID NO: 5968 - protein, 320 aa, Emericella nidulans
MDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 5969 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 5970 - protein, 339 aa, Oryza sativa; identical to SEQ ID NO: 5693

SEQ ID NO: 5971 - protein, 478 aa, Hymenena flabelligera
LKNERYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLFSQLEVNLPQGIFFKQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVETPTANV

SEQ ID NO: 5972 - protein, 480 aa, Phycodrys radicosa
GQVKNDRYESGVIPYAKMGYWDPEYVIKETDILTLFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMEEIYERAEFAKQLGTIIIMIDLVIGYTAIQSMGIWARKNDMILHLHRAGNSTYSRQKIHGMNFRVICKWMRMAGVDHIHAGTVVGKLEGDPLMIKGFYDTLLLPALEVNLPLGIFFKQDWASLRKVTPVASGGIHCGQMHQLLDYLGDDVVLQFGGGTIGHPDGIQAGATANRVALESMVIARNEGRPFVEEGPQILRDAAKTCGPLQTALDLWKDITFNYTSTDTADFVETPTANV

SEQ ID NO: 5973 - protein, 399 aa, Novosphingobium aromaticivorans
MDEEFYRMKRLPPYVIAEVNGMRAAARAAGRDIIDLGMGNPDLPPPQHVIDKLCEVAQKPDAHGYSASSGIPGVRKAQANYYGRRFNVDLDPETEVVMTMGSKEGLASLATAITAPGDVVLAPNPSYPIHTFGFIIAGATIRSVPTTPDERYWDSLDRAMKYSVPRPSILIVNYPSNPTAETVDLAFYERLVAWAKENKVWILSDLAYSELYYDGNPTRSILEVPGAKDVAVEFTSMSKTFSMAGWRVGFAVGNQRLIAALKRVKSYLDYGAFTPIQAAACAALNGPQDIVVKNRELYQKRRDVMVEAFGRAGWEIPSPSASMFAWAPLPPALTHLGSLEFSKQLLTHAEVAVAPGVGYGEDGEGFVRIAMVENEQRLRQAARNIKRYLQSMGVNASAA

SEQ ID NO: 5974 - protein, 161 aa, Glycine max
  unsure (1)..(161): unsure at all Xaa locations
CSRLWPRKSWWRVSSPATLTLLLLTCSFLTLILLALHILSTPHANANSSVSRNTHIEAEEDDQVALRMEVIXSWXPTAFLYHTFLTKEECEYLINIATPHMQKSTVADNQSGQSVVHDVRKSTGAFLDRGQDEIVRNIEKRIADVTFIPIENGEPIYVIHY

SEQ ID NO: 5975 - protein, 194 aa, Helicobacter pylori J99
MKIFFIDNFDSFSYNLVYELECLGYEVAVYQNDIDPSYLMGLMNEEPKTPLLFISPGPGNPNSSGNLLKIIAMAKKKFPILGVCLGLQALAQSYGAKIIRSKEIVHGKATTIALKKHAVFKGLGESMVVGRYHSLMASGLPKNLEVIAEHDNIPMAIVNEEDKILAYQFHPESIMTLQGRALLEQSVGFLRELS

SEQ ID NO: 5976 - protein, 252 aa, Triticum aestivum
  unsure (1)..(252): unsure at all Xaa locations
MMGYQKGVDIEAGTSGGGTGTAAPTRGLYPGMTESPELRWALIRKIYVILSLQLLLTAVVAAVVVKVRAIPHFFVSSXPGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 5977 - protein, 165 aa, Glycine max
  unsure (1)..(165): unsure at all Xaa locations
MGSSHVTANGHAPLDSGHARLKELGYKQELKRDLSVISNFAFSFSIISVLTGVTTLYNTGLNYGGPVSLVYGWFVASGFTMLVALSMAEICSSYPTSGGLYYWSAKLAGPRWAPFASWITGWFNIVGQWAVTTSVDYSLAQLIQVIILLSTGGKNGXGYEASKYV

SEQ ID NO: 5978 - protein, 213 aa, Vibrio mimicus
AGSDLALYDIAPVTPGVAADLSHIPTPVTIKGYAGEDPTPALEGADVVLVSAGVARKPGMDRADLFNVNAGIVKALAETIAVVCPKACVGIITNPVNTTVPIAAEVLKKAGVYDKRKLFGVTTLDVIRSETFVAALKDKDPGQVRVPVIGGHSGVTILPLLSQVEGVTFTDEEVAALTKRIQNAGTEVVEAKRGGGSATLSMGQAACRFGLPL

SEQ ID NO: 5979 - protein, 236 aa, Oryza sativa
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVGVPRI

SEQ ID NO: 5980 - protein, 159 aa, Glycine max
  unsure (1)..(159): unsure at all Xaa locations
VFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASXVAEGKVPIGVGAN

SEQ ID NO: 5981 - protein, 108 aa, Zea mays
  unsure (1)..(108): unsure at all Xaa locations
MPLHASGLMLPHFLVWRSTHPLVPLPHHLPRSADGNEVFFRIKRSTQLKXLMNAYCDRQSVCMNAXGGCLFPRLRLYLKPTPDELEMEXGDEIDAMLHQTGGSVPSTT

SEQ ID NO: 5982 - protein, 299 aa, ASPERGILLUS NIDULANS FGSC A4
MPFTSALVALVQILIAVAPSLQLQGELQAKSEAVKKYKGVLHGVKVILQNEGPRGLFRGIGSAYIYQVLLNGCRLGFYEPIRNGLTTAVYNDSHVQSLGINVFAGASSGIIGAAAGSPFFLVKTRLQSFSPFLPVGTQHQYRNSFDGLRKIFASEGVGGLYRGVGAAMVRTGFGSSVQLPTYFFAKRRLVKHLGMEDGPALHLASSTASGFVVCCVMHPPDTIMSRMYNQTGNLYKGVFDCLAKTIRTEGLFAIYKGYFAHLARILPHTILTLSLAEQTNKLMRRVEDRLLSDSLKSRL

SEQ ID NO: 5983 - protein, 435 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 5984 - protein, 510 aa, Oryza sativa
MFIESFRVESPHVRYGAAEIESDYQYDTTELVHESHDGASRWIVRPKSVRYNFRTTTTVPKLGVMLVGWGGNNGSTLTAGVIANREGISWATKDKVQQANYYGSLTQASTIRVGSYNGEEIYAPFKSLLPMVNPDDLVFGGWDISNMNLADAMTRAKVLDIDLQKQLRPYMESMVPLPGIYDPDVIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYELGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 5985 - protein, 496 aa, Nicotiana plumbaginifolia
MAGNGVFVDIIEGDVFKYYSEGEWKKSASGKSVAIINPTTRKTQYKVQACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTMHPGVHCISFTGGDTGVAISKKAGMIPLQMELGGKDACIVLEDADLDLAAGSIVKGGFSYSGQRCTAVKVVLVMESVADALVEKVNAKVAKLTVGPPEDDCDITPVVSESSANFIEGLVMDAKQKNATFCQQYKREGNLIWPLLLDNVRPDMRIAWEEPFGPVLPVIRINSVEEGIHHCNASNFGLQGCVFTKDINKAILISDAMETGTVQINSAPARGPDHFPFQGIKDSGIGSQGITNSINMMTKVKTTVINLPTPSYTMG

SEQ ID NO: 5986 - protein, 362 aa, Xylella fastidiosa Temecula1
MSISFDIARSLSTTSDEELSMILQAPGFGVHFTDHMIAIAWDKDNDWHDAQVRAYGPLLLDPAAAVLHYGQEIFEGIKAYRHADGSIWTFRPEANARRLQRSAKRLVLPELPVELFTESLRQLIAVDARWVPSAPETSLYFRPFMIATEAYLGVRAAQHASYYLIASPAGPYFAKGVTPVSIWLSTDCARAALGGTGAVKCGGNYAASLLPQQVAQTQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 5987 - protein, 181 aa, Triticum aestivum
  unsure (1)..(181): unsure at all Xaa locations
LRRASARRRLPAVNAKTPVPAKKVELQVAGLMSGDQVLKTXSFFGDEVWPADKLGFTKTAIQAKPDSVYFVVSRGGGDIDVKRLPKRPAPPRFGRKLSDSQKARATHICLDCGYIYFLPKAFEEQPDEYGCPQCNAPKKRFARYDVESGKPIGGALPPLTVIVSLVIGIAGIGALLVYGLQ

SEQ ID NO: 5988 - protein, 372 aa, Eucalyptus grandis
MAKIAPGCEPVAGTLTPSKKREYRVTNRLQEGKRPLYAVVFNFIDSRYFNVFATVGGNRVTVYQCLEGGVIAVLQSYIDEDKDESFYTVSWACNIDRTPFVVAGGINGIIRVIDAGNEKIHRSFVGHGDSINEIRTQPLNPSLIVSASKDESVRLWNVHTGICILIFAGAGGHRNEVLSVDFHPSDKYRIASCGMDNTVKIWSMKEFWTYVEKSFTWTDLPSKFPTKYVQFPVFIAPVHSNYVDCNRWLGDFVLSKSVDNEIVLWEPKMKEQSPGEGSVDILQKYPVPECDIWFIKFSCDFHYHSIAIGNREGKIYVWELQSSPPVLIAKLSHSQSKSPIRQTAMSFDGSTILSCCEDGTIWRWDAITASTS

SEQ ID NO: 5989 - protein, 507 aa, Campylobacter jejuni
MKKLTNDFGNIIADNQNSLSAGTKGPLLMQDYLLLEKLAHQNRERIPERTVHAKGSGAYGEIKITADLSAYTKAKIFQKGEITPLFLRFSTVAGEAGAADAERDVRGFAIKFYTKEGNWDLVGNNTPTFFIRDAYKFPDFIHTQKRDPRTHLRSNNAAWDFWSLCPESLHQVTILMRDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSLVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIATSMEGVDEKIITRALEHFEKISPDYAKGIKKAFPIVSRIRAWRNHGHRCFLCEIVIRSQFHTTYEPEA

SEQ ID NO: 5990 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 5991 - protein, 283 aa, Lycopersicon esculentum
MPPYGTPVPYPALYPPAGVYAHPNIATPAPNSVPANPEADGKGPEGKDRNSSKKLKVCSGGKAGDNGKVTSGSGNDGATQSDESRSEGTSDTNDENDNNEFAANKKGSFDQMLRDGASAQNNPAKENHPTSIHGICTMPATNLNIGMDVWNASAAGPGAIKIQQNATGPVIGHEGRMNDQWIQEERELKRQKRKQSNRESARRSRLRKQAECEELQRRVEALSHENHSLKDELQRLSEECEKLTSENNLIKEELTLLCGPDVVSKLERNDNVTRIQSNVEEAS

SEQ ID NO: 5992 - protein, 428 aa, Zea mays
MAGPKAAEDGSAAPLLPAQAGERSSGGVGGGATSAQTLGNVVVSIVGTGVLGLPYAFRAAGWVAGSIGVAAAGSATLYCMLLLVDCRDKLKEEETEECCHGHYTYGDLGDRCFGTIGRCLTETLVLVSQAGGSVAYLIFIGQNLHSTFSQLMSPAGFIFAILLPLQIALSFIRSLSSLSPFSIFADVCNVLAMAIVIKEDLQLFDHPFSNRSAFNGLWAVPFTFGVAVFCFEGFSMTLALEASMADRRKFRSVLSQAVAAIIAVYVCFGVCGYLAYGEATKDIITLNLPNNWSSAAVKVGLCIALAFTFPVMMHPIHEIVETRFRSNRCFRKLSHNDGGAEWIGLHASRVLVVAVLTVVASFIPFFGSFISFVGSTMCALLSFVLPALFHLSIVGSSIPLWRRVLDYGILLFGLAFAGYGLVTALSSH

SEQ ID NO: 5993 - protein, 850 aa, Oryza sativa
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKTNRYIWVFANAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 5994 - protein, 737 aa, Halobacterium sp. NRC-1
MRLTVKQLKNRDPGSGMAVIDRDALQEIGVSSGDFVAIEGRNGGRTVARVWPSNTSDAGRGIIRIDGQLRQAANVSIDDRVEVEKTEVEPADRVTVSLPQNLQIRGDLGSHLREHLVDQAVRAGQTVAFPIGFGMFSGRSGRRIPLRVVDTQPSGTVVVQNTTEIEIADQSAQEVSVESGEPENTTAPALTYEDIGGLDDELEQVREMIELPMRHPELFGTLGIEPPKGVLLHGPPGTGKTLIAKAVANEIDAHFQTISGPEIMSKYYGESEEQLRDVFEEAEENAPAIVFIDELDSIAPKREDVSGDVERRVVAQLLSLMDGLEERGQLTVIGTTNRVDAVDPALRRPGRFDREIEIGVPDHDGREKILQIHTRGMPLGDGVDLDRYAENTQGFVGADLENLVKESAMHALRRIRPDLDLDEEEIPADILDSIEVTENDFKEALRGIEPSALREVFVEVPDVTWDHVGGLDDAKERLQETVQWPLEHADAYEQVALEPAKGVLLYGPPGTGKTLLAKAVANEANSNFISIKGPELFNKYVGESERGVREVFSKARENAPTVVFFDEIDAIASERGQGVGDSNVGERVVSQLLTELDGLEELEDIVVIATTNRPDLIDDALLRPGRLDRHVAVDEPDEAARREIFEIHTEDKPLAEDVDVDELVERTDGYVGADIEAVCREAATVAVREYVRATASAESANVDEIELSIEHFEQALEEVDSNAGSETQAFEKPAEAV

SEQ ID NO: 5995 - protein, 141 aa, Oryza sativa
THHTRARARRSREREKVDGKVVWITGASRGIGEVLAMQFASLGAKLILSARNKEELERVKHNIINKHPNSRVEVLPMDLSSGEESLKEHVHEAESLFSNAGVDYMIHNAAFERSKRRALEETEQGLKATFDVNVFGTITLT

SEQ ID NO: 5996 - protein, 505 aa, Methanosarcina barkeri
MGEKNSSKVLTTGFGIPVGDDQNSLTAGNRGPVLMQDVHLLDKLSHFDHERIPERVVHAKGAGAGGYFEVTADVTKYTKAKFLSEIGKRTEVFVRFSTVGGEKGSADSARDPRGFAVKFYTEDGNYDLVGNNTPVFFIRDPLKFPDFIHTQKRNPATNCKDPDMFWDFLSLTPESIHQVTILFSDRGTPATYRNMNGYSSHTYKWYNEKGEYFWVQYHFKTDQGIKNLTLEEAEKIGGSDPDHATRDLYEAIKKGDYPSWTLEMQIMTPEQAEDYRFDIRDITKVWPHGDFPTMKIGKLVLNRNPTNYFAEVEQAAFSPANLVPGIGISPDKMLQGRVFSYHDTHIHRLGPNYNLIPVNAPKYSPENSYQRDGFMRVDANGGSGPNYWPNSFGGPSPDSVYLEPPFGVSGLAARTLYTHPNDDFVQAGNLYRDVMTDYDRENLVGNIVSHLSAAQKRIQLRQTALFFKADRDYGSRVAKGLELDIKEVERLANMTNEERARATER

SEQ ID NO: 5997 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 5998 - protein, 729 aa, Arabidopsis thaliana
MWRLRIGAKAGDDPHLCTTNNFLGRQIWEFDANAGSPAELSEVDQARQNFSNNRSQYKACADLLWRMQFLREKNFEQKIPRVRIEDAKKITFEDAKNTLRRGIHYMAALQSDDGHWPSENAGCIFFNAPFVICLYITGHLDKVFSEEHRKEMLRYMYNHQNDDGGWGIDVESHSFMFCTVINYICLRIFGVDPDHDGESACARARKWIIDHGGATYTPLFGKAWLSVLGVYEWSGCKPIPPEFWFFPSYFPINGGTLWIYLRDTFMAMSYLYGKKFVAKPTPLILQLREELYPQPYAEIVWSQARSRCAKEDLYYPQSLVQDLFWKLVHMFSENILNRWPFNKLIREKAIRTAMELIHYHDEATRYITGGAVPKVFHMLACWVEDPESDYFKKHLARVSHFIWIAEDGLKIQTFGSQIWDTAFVLQVMLAADVDDEIRPTLIKGYSYLRKSQFTENPPGDYINMFRDISKGGWGYSDKDQGWPVSDCISESLECCLIFESMSSEFIGEKMEVERLYDAVNMLLYMQSRNGGISIWEAASGKKWLEWLSPIEFIEDTILEHEYLECTGSAIVVLARFMKQFPGHRTEEVKKFITKGVKYIESLQIADGSWYGNWGICFIYGTFFAVRGLVAAGNTYDNCEAIRRAVRFLLDIQNGEGGWGESFLSCPNKNYIPLEGNKTDVVNTGQALMVLIMGGQMDRDPLPVHRAAKVLINSQMDNGDFPQQVCFLLP

SEQ ID NO: 5999 - protein, 192 aa, Bacillus anthracis str. A2012
MIDNYDSFTFNLVQFLGELGQELVVKRNDEVTISDIENMKPDFLMISPGPCSPNEAGISMDVIRYFAGKIPIFGVCLGHQSIAQVFGGEVVRAERLMHGKTSPMHHDGKTIFSDIPNPFTATRYHSLIVKKETLPDCLEVTSWTEEGEIMALRHTTLPIEGVQFHPESIMTSHGKELLQNFIRKYSPSVTSC

SEQ ID NO: 6000 - protein, 656 aa, Glycine max
  unsure (1)..(656): unsure at all Xaa locations
PEKPSSVFTKRSSQTATLQHKKPASSVDAEIVGGSTISSQAMLKQEVSTASSKGTTLKEGDRVKFVGNFPSAVSSLPNYPSRGPSYGSRGKVLLAFEDNRSSKIGVRFDKSIPDGNDLGGLCEEDRGFFCSANHLLRVDGSGGDDADKVAISDIFEVTSXESARAARGKSGPLVLFIKDIEKAMVGNYEVLKNKFESLPPNVVVIGSHTLLDNRKEKTQPGGLLFTKFGSNQTALLDLAFPDNFGRLHDRSKETPKVMKQLGRLFPNKVTIQLPQDEALLSDWKQQLERDIETMKAQSNIVSVCTVLNRIGLDCPDLETLCINDQTLTTESVEKIIGWAISYHFMHSSEASIKDSKLVISAKSINYGLNILQGIQNENKNLKKSLKDVVTENEFEKKLLADVIPPTDIGVTFDDIGALENVKDTLKELVMLPLQRPELFCKGQLAKPCKGILLFGPPGTGKTMLAKAVATEAGANFINISMSSITSKWFGEGEKYVKAVFSLASKIAPSVIFVDEVDSMLGRRENPGEHEAMRKMKNEFMVNWDGLRTKDKERILVLAATNRPFDLDEAVIRRLPRRLMVNLPDAPNREKIVRVILAKEELAPDVDFEAIANMTDGYSGSDLKNLCVTAAHCPIREILEKEKKERSLALTDIFLFV

SEQ ID NO: 6001 - protein, 267 aa, Oryza sativa
MVVVTAAAPPLGIALVGPTRARRGGGLSLSSSSCCYLSMCGRGVLRGGCARMREPLPPAPIGLDRFLCGYMRRDGHEDGERSQGIEDSLMFGPDDDNGSNIPTQVETLVRGTATVATPEYKSIPDLDYLQNDLIHLVVMQELLAIQQQGPRAIGFFGTRNMGFMHQQLIEILSYAMVITKNHIFTSGASGTNAAVIRGALRAEKPELLTVILPQSLKKQPPESQELLSKSSILLVCHRFGLTSGWLVIEYLVQLAVFTLKLRNDTAE

SEQ ID NO: 6002 - protein, 324 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSK

SEQ ID NO: 6003 - protein, 256 aa, Glycine max
MVILLYLRLELEVMAIGNENQPQQSEGKVWNLFKLPFRHSTSTPHNHNQVSTSNSVSSFAKSLLPSPRRLKLDPSNKLYFPYEPGKQGRSAIRIKNTSKSNVAFKFQTNAPKSCFMRPPGGILAPGESIIATVFKFIEHPLNNEKPEKTGLKFKITSLKVKGPIDYVPEMFDELKDQVTVEQILQVVFLDPERNCPALEKLKLQLVEADAAVEARKRAPEDAGPKILGEGLVVDEWKERSERYLAKQQGEVVVDSI

SEQ ID NO: 6004 - protein, 757 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHIWKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNTCMLHYATYRNTFPLWALAEYRKVVFIVN

SEQ ID NO: 6005 - protein, 148 aa, Listeria monocytogenes
IMYLFSDEGTPASYREIRGSSVHAFKWINEEGKTVYVKLRWIPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGM

SEQ ID NO: 6006 - protein, 466 aa, Zea mays
  unsure (1)..(466): unsure at all Xaa locations
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIRKEKSSFGFIDYYDRRYAALAILSLNGRQLYGQPIKVNWAYTSTPREDTSGHFNIFVGDLCPEVTDATLFAFFSGYSTCSDARVMWDQKTGRSXRGFGFVSFRNQQDAQSAINDLNGKWLGNRQIRCNWAXTKVPNAGEEKQILDTKVDLSNGSSESGKENPNEDGPENNPQFTTVYVGNLPHEATMNDVHLFFHSLGAGSIEEVRVTRDKGFGFVRYSTHEEAALXAIQMGNGQLIGGRQIKSCASICCXCSWGSKPTPQGTASLPLPPPALAPFSTGVSATDLLAYQRLALSKMAXSNHPALMGQHSLKQVAALGIXGGGASQSIYDGXGFQGINTVTGTTSAQQQQQQQQQQLMYY

SEQ ID NO: 6007 - protein, 389 aa, Streptomyces vinaceus
MTGPLGAGPQALPAAPLEDWLRERYFQAKTDISSSGVHNYTFGELRALDPALLGTRELDQLMFRDGPSLGDERLRAAVAARVRPGPGHVVMTTHGSSEALYLAFAALVRPGDEVVVATPAYHSLSGLATAAGASLRPWPLRPENGFAPDLDDLRAVLSDRTRLVVVNFPHNPSGACVDPRGRTELLDLVANSQAVLLWDGAFTDLVHDHPPLAEPSQDLDRVLSFGTLSKAYGLPGLRVGWCVVPQDLVSELVRIRDYLTLSLSPLVERVAAVAVEHADALITPRLTEARHNRRRVLEWAAASEGAIDCPVPRGGVTAFPRFTAHTDVTDLCERLLARHGVLVVPGRVFGQADRMRIGFSCPRPELERGLAAISEELGTHARGRRRGTG

SEQ ID NO: 6008 - protein, 136 aa, Zea mays
  unsure (1)..(136): unsure at all Xaa locations
MDTSKSKQGPEHLLVLGHGIMASPKDWTYGEAVLKRRLGDDFLIFVPAHGGGGGFVACSRPLGALVGLRILTPLLNFQNEYCVGGSPKTLAVVXGGPLISYAGRAQLLEIVPVPAVRVGELSSVAKLLMFSTNVSW

SEQ ID NO: 6009 - protein, 343 aa, Pseudomonas fluorescens PfO-1
MSNSTEPTTFTGWAATSAGAPLERFSYDPGPLGDEEVEVAVEYCGVCHSDQSLIDNDWGISQYPFIPGHEVVGRIVRTGPQVRGLEVGQRVGIGWYKGSCMHCSSCIGGSHHLCATAKPTIIGSHGGFADRLRTHWAWALKLPDNLDPALAGPLFCAGSTVFNPLVEFDIKPTDRVGVVGIGGLGHLALRFLNAWGCDVTAFTSSLSKQDEAKRLGAHKVVASTDSEALKAIAGTLDFLLITANANLDWTAMLATLRGKGRLHFVGIVPDAIPVHVFNLIPQQKSLSASPVGSPATAATMLEFCARHQILPQVEEFPMSKVNEAVDHLRSGKARYRIVLNASK

SEQ ID NO: 6010 - protein, 184 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTT

SEQ ID NO: 6011 - protein, 353 aa, Pseudomonas aeruginosa PAO1
MSTPPFRVALNGYGRIGRCVLRALHERPEQLGFEIVALNDLADQASVEYLTRFDSTHGRFPGEVKVDGDCLHINGDCVKVLRSPTPEAIDWQALRVDLVLECSGQYTNRAQAERFLRAGAPRVLFSQPMASEADIDATIVYGVNQQDLSGRETLVSNASCTTNCGVPLLKLLNEAIGLEYVSITTIHSAMNDQPVIDAYHHEDLRRTRSAFQSVIPVSTGLARGIERLLPELAGRIQAKAIRVPTVNVSALDITLQTSRDTSAAEINRVLREAAESGPLRGLLAYTELPHASCDFNHDPHSAIVDGSQTRVSGPRLVNLLAWFDNEWGFANRMLDVAGHYLRAAVPDQQVPKD

SEQ ID NO: 6012 - protein, 158 aa, Zea mays
CSAPAAAGQGFLSKQSRWIWEFEKCGVILRHHCGPRDGNWIHILYKRSYDARKALQKNVMQLSSSLIVGVKPIDAVHRQQLDKSFTPSNPGGFMVSLPSKSLGLKSAGASNQLGGFNRLYDLKANTNVSRDAGRRATGSVAAPAKSIVTNVMDLVFGI

SEQ ID NO: 6013 - protein, 488 aa, Zea mays
MASLWLARASSQLARRAAARRPPPRPGRHGSGQPTSSWFLGSVPQAALGSPALDTSRRGFCSVRRFAGESSAAAAAAAVVDEEPESGFAAGDQQAVDFPGGKVSFVAEMNFLPESTRERINCYRVLDDDGRTISGSRFQEVSRELALKMYSEMVTLQIMDTIFYEAQRQGRISFYLTSNGEEAINIASAAALSMDDIVLPQYREPGVLLWRGFTLQEFANQCFGNKLDYGKGRQMPIHYGSNRLNYFTVSSPIATQLPHAVGAAYSLKMDKKDACAITYFGDGGTSEGDFHAALNFAAVMEAPVIFFCRNNGWAISTPTTEQFRSDGVVIRGQAYGIRGIRVDGNDALAVYSAIHAAREMAVTEGRPILVEALTYRVGHHSTSDDSTKYRPVDEIEHWRTARDPISRYRKWVQGNDWWSDAEESELRSRVRKELLQAIQVAERMPKPPVTELFTDVYDKIPSNLHEQEQLLRDTIMRHPADYPTDVPV

SEQ ID NO: 6014 - protein, 468 aa, Thalassiophyllum clathrus
IPYAKMGYWDADYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPYAYLKTFQGPATGVVVERERLDKFGRPLLGATVKPKLGLSGKNYGRVVYEGLCGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEEDPLMVKGFYNTLLLTHLKINLAEGLFFDMDWASLRKCVPVASGGIHCGQMHQLLYYLGDDVVLQFGGGTIGHPDGIQSGATANRVALESMVLARNEGRDYVGEGPEILRNAAATCGPLKAALDLWKDITFEYTSTDTPDFVELPTESN

SEQ ID NO: 6015 - protein, 555 aa, Saccharomyces cerevisiae
MLVLSLIYSVSFPFFSSEKEVTMTEDNIAPITSVKVVTDKCTYKDNELLTKYSYENAVVTKTASGRFDVTPTVQDYVFKLDLKKPEKLGIMLIGLGGNNGSTLVASVLANKHNVEFQTKEGVKQPNYFGSMTQCSTLKLGIDAEGNDVYAPFNSLLPMVSPNDFVVSGWDINNADLYEAMQRSQVLEYDLQQRLKAKMSLVKPLPSIYYPDFIAANQDERANNCINLDEKGNVTTRGKWTHLQRIRRDIQNFKEENALDKVIVLWTANTERYVEVSPGVNDTMENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYMKPVGDSKVAMDEYYSELMLGGHNRISIHNVCEDSLLATPLIIDLLVMTEFCTRVSYKKVDPVKEDAGKFENFYPVLTFLSYWLKAPLTRPGFHPVNGLNKQRTALENFLRLLIGLPSQNELRFEERLL

SEQ ID NO: 6016 - protein, 446 aa, Chenopodium rubrum
MAARAVLQEQPRGGVQQKNGQGGERRNRTALGDIGNVVTARGGAIGAANGIAKPQAINRPLTRSFCAQLVANAQAAAEKKKKQGVKAVDVNVGGARKAGVGVAVAPAAAAQKKVQEKKKTEVVVAETKTPSGHGKVEQKPASKKKKTPTFTSFLTARSKEACGLSKKPQELIVNIDEGSVEDELAVVEYVEDIYSFYKIAEDESRVRDYMDSQPDINEKMRSILVDWLIEVHYKFELRQETLYLTINIIDRFLSMKIVPRKELQLVGIASMLIACKYEEIWAPEVNDFVQISDKAYVREQVLCMEKTILGNLEWYLTVPTPYMFLTRYVKASVTLDSEMENMSYFFSELGMMNYSTTIKYPPSLLAASSVYTARCTLNNSPSWTETLKHYTGYSENQLLECARLLVSFHMAAPEGRLRAVYKKFSKPDNGAVALRPPAKSLLASTS

SEQ ID NO: 6017 - protein, 390 aa, Enterococcus faecalis V583
MTQHMKSQCETEEVALLDSLGRISGETIFAETAIPHFPRAGMDGYAVRAVETRGATAESPSCLKVVGSLVAGDSMFYCNQTNNCAIKITTGAFIPTDFDAVVPQEWTDFGQDHVKIFRSVTAGQNYAEIGEDIAFQQKILAKHQQINSRMIGLLAMQGIDKVVVLKRMKVGILATGSELVSLEEPLSVGKIYNSNLYMLAAFVKASGNEVIHLDHCSDDPEELAKRLIEISPKLDVLITCGGVSVGEKDNLPLAIKRIGGTELFHFVNMKPGTPVMGSQFQETLILSVSGNPFAAMVNLHLFYWTLLATFFNCVELNLKERTVILAHELTPSRLRRFYRAKEIDGTVNLVTKSHLSSNLSNTLETNCLLEQPAGVLLKKGALVKVYYWQT

SEQ ID NO: 6018 - protein, 347 aa, Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 6019 - protein, 203 aa, Carboxydothermus hydrogenoformans
  unsure (1)..(203): unsure at all Xaa locations
PGRDRSGIEDIIDAGITDIGVIIAPETGEXIKKSITNAGFPAKFTFILQEKPLGLAHAVKVAKDYLEDDDFIMYLGDNLINSGIKEFVEEYKENRYDATILLKEVQDPTRFGVAVVDENFXVQRLIEKPKEPPSNLALVGIYIFSPXIFSAMTGIKPSWRGELEITDAIQELIYQGGVVKAHNITGWWLDTGEKRRFIGKQTG

SEQ ID NO: 6020 - protein, 143 aa, Chloroflexus aurantiacus
MTNLTRWDPFREMTQLLDDTFFTGFTGVLPRNGSLVPALDLSETADAYHIEMAVPGMTADQLNITFENNVLTISGEITQSSDRKERQYHVTERRFGRFSRSIRLPNQIHPDRIEARLENGVLTVTVPKAEEIKPRKIAVNVAQ

SEQ ID NO: 6021 - protein, 200 aa, Shigella dysenteriae
ADILLLDNIDSFTYNLADQLRSNGHNVVIYRNHIPAQTLIERLATMSNPVLMLSPGPGVPSEAGCMPELLTRLSGKLPIIGICLGHQAIVEAYGGYVGQAGEILHGKASSIEHDGQAMFAGLTNPLPVARYHSLVGSNIPAGLTINAHFNGMVMAVRHDADRICGFQFHPESILTTQGARLLEQTLAWAQRKLEPTNTLQ

SEQ ID NO: 6022 - protein, 529 aa, Zea mays
MSSVGSGSGTRAANGAAAISAAATAAGSADARFHPQLLQQDRQSRWAGCFSGLSCFGSQKGGKRIVPAARTSDGNGSNARGNGLQSGANSNQNMPMNLSLLAPPSSPASFSNSALPSTAQSPNCFLSVSANSPGGPTSNMFAVGPYANEPQLVSPPVFSTYTTEPSTAPLTPPPELAHATTPSSPDVPYARFLSSSMDIKTASKEHNMPFLSTTYSGGSGLQASYPLYPESPCSSLISPASVTPRTGLSSPIPEQEVPPAHWKTSRSACDTPYFRASPIPEQETTAQWKTSRSACDTPYARTSPTNIFGLDSNTPRNYMLDSNFFRPAASAQFYLDQAQQAFPHNGGRVSVSREKQDADEIEAYRASFGFSADEIVQSQSYVGIPDAVDESFSISPFGNNAPATEICPFSDLPSEVQKADKSCTYVKDGTSPKKSANHLSIDSPNKVLRLDVFKVTKGGHLSEDEGIARDGHPFRRTTDEISLKPIEVRKKSPPGHSCSDAEIEYRRTRSLRDANGVLSRRSALARQLH

SEQ ID NO: 6023 - protein, 1116 aa, Schizosaccharomyces pombe
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 6024 - protein, 392 aa, Lycopersicon esculentum
DARKSPPTWLNTSLLRQQHSQFGNSSSPSSAAAAAAVAGGNNFLHLQTSNSDSSNSNQWLSPTAAAGGGGNGGGGGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLARETGLQLKQINNWFINQRKRNWHSNPSTSSSQKSKRKSAGEIKQ

SEQ ID NO: 6025 - protein, 358 aa, Cryphonectria parasitica
MAEFVRAQIFGTTFEITSRYSDLQPVGMGAFGLVCSARDQLTNQNVAIKKIMKPFSTPVLAKRTYRELKLLKHLRHENIISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLASKFKNADEQAVDLLERMLVFDPKKRITASDALAHEYLAPYHDPTDEPVAEEKFDWSFNDADLPVDTWKIMMYSEILDYHNVDASGASAAMGEFNGQ

SEQ ID NO: 6026 - protein, 478 aa, Oryza sativa
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 6027 - protein, 314 aa, Anabaena sp.
NGFGRIGSNFARCWLGRENSNIDLVAVNDTSDPRTNAHLLKYDSMLGKLKDVDITADDNSIIVNGKTIKCVSDRNPENLPWKEWEIDLIIEATGVFTSKEGALKHVNAGAKKVLITAPGKNEDGTFVIGVNHHEYDHNVHHIISNASCTTNCLAPIAKVLHEKFGIIKGTMTTTHSYTGDQRLLDASHRDVRRVRAAAINIVPTSTGAAKAVALVIPELKGKLNGVALRVPTPNVSMVDFVIQVEKRTITEEVNQALKDAAEGPLKGILDYSELPFVSSDYQGSDASSIVDANLTLVMDNDLVKVMAWYDNEWG

SEQ ID NO: 6028 - protein, 392 aa, Zea mays
  unsure (1)..(392): unsure at all Xaa locations
MAVAAFPSCGAFAPPCLVSTRRAFSSVVAMASAAPVRAPSRKPFAPPREVHRPVAHSLPPQKREIFESLESWAADNILVLLKPVERSWQPQDYLPDAASESFDDEVRELRERAREIPDDYFVCFVGDMASASWATXVTEEALPTYQTMLNTLDGGVRDETGASSTSWAVWTRAWAAEENRHGDLMNKYLFLTGRVDMRQIEKTVQYLIASGMDPKTETNPYMGFVYTSFQERATFISHGNTARHARRYGDTKLAQICGTIAADEKRHESAYERIVEKLFEVDPDYTVRAFADTMRKKVAMPAHLMYDGQDDGLFARFSAVAQRIGVYTARDYVDILEFLVRRWGVQELTGLSGEGRRPQQWVRGLGPRVNDNKAKDPEFAPFSWIHGRQVQL

SEQ ID NO: 6029 - protein, 758 aa, Pisum sativum
MWRLKIAEGGNDPYLFSTNNFVGRQTWEYDPEAGSEEERAQVEEARRNFYNNRFEVKPCGDLLWRFQVLRENNFKQTIGGVKIEDEEEITYEKTTTTLRRGTHHLATLQTSDGHWPAQIAGPLFFMPPLVFCVYITGHLDSVFPPEHRKEILRYIYCHQNEDGGWGLHIEGHSTMFCTALNYICMRILGEGPDGGEDNACVRARNWIRQHGGVTHIPSWGKTWLSILGVFDWLGSNPMPPEFWILPSFLPMHPAKMWCYCRLVYMPMSYLYGKRFVGPITPLILQLREELHTEPYEKINWTKTRHLCAKEDIYYPHPLIQDLIWDSLYIFTEPLLTRWPFNKLVRKRALEVTMKHIHYEDENSRYLTIGCVEKVLCMLACWVEDPNGDAFKKHIARVPDYLWISEDGMTMQSFGSQEWDAGFAVQALLATNLIEEIKPALAKGHDFIKKSQVTENPSGDFKSMHRHISKGSWTFSDQDHGWQVSDCTAEGLKCCLLLSLLPPEIVGEKMEPERLFDSVNLLLSLQSKKGGLAAWEPAGAQEWLELLNPTEFFADIVVEHEYVECTGSAIQALVLFKKLYPGHRKKEIENFIFNAVRFLEDTQTEDGSWYGNWGVCFTYGSWFALGGLAAAGKTYTNCAAIRKGVKFLLTTQREDGGWGESYLSSPKKIYVPLEGNRSNVVHTAWALMGLIHAGQSERDPTPLHRAAKLLINSQLEQGDWPQQEITGVFMKNCMLHYPMYRDIYPLWALAEYRRRVPLP

SEQ ID NO: 6030 - protein, 466 aa, Batrachospermum helminthosum
LCKMGYWDPDYVIKETDVLALFRITPQPGVDPVEAAAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFARELGSIICMIDLVVGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGRDFVNEGPQILRDAAKTCGPLQTALDLWKDISFNYTSTDTADFVETPTANI

SEQ ID NO: 6031 - protein, 273 aa, Arabidopsis thaliana
SSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 6032 - protein, 76 aa, Zea mays
MADPELEAIRQRRMRELQHGAANQQNAGQEKAQEDAKQEAEERRQMMLAQILSSEARERLSRIALEVVNKCVLFLC

SEQ ID NO: 6033 - protein, 328 aa, Bacillus subtilis subsp. subtilis str. 168
MDILLILTILIVICALAFDFINGFHDTANAIATSVSTKALKPRHAIILAAVMNFVGAMTFTGVAKTITKDIVDPYTLENGSVVILAALLAAIAWNLITWYYGIPSSSSHAIIGAIAGAAIAAAGFAALNYKGFIKIIEALILSPIIAFVLGFILYSIVKLIFKDSNLAKTNKQFRRVQIVTAALQSYTHGTNDAQKAMGIITMALITANLHTSANDIPTWVQFACATAMGLGTSIGGWKIIKTVGGKIMKIRPVNGVSADLTGAAIIFGATFIHLPVSTTHVISSSILGVGASHRVKGVNWGTAKRISLHGSSRFRFQRHLVPSPTLF

SEQ ID NO: 6034 - protein, 120 aa, Zea mays
RQRQRRAAAAAAPKGCVTVRVGLEGEEQRRFAVPLGHLKHPLFGALLEEAEREYGFRHQGALAIPCRVDRFVQLERLIGRDLHGACAHHLVDLDGAAAAAAQHQHQHHLHLPRFVGCFRA

SEQ ID NO: 6035 - protein, 171 aa, Frankia sp. R2
FFIHDPITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTVTFMPKP

SEQ ID NO: 6036 - protein, 435 aa, ASPERGILLUS NIDULANS FGSC A4
MLRLQTALFFAYLAARSLAADDFTPPSCSLDEHCPKEYPCCSVYGQCGTGAYCLGGCDPLMSYSLDSCAPMPVCESKSYKWENLDSAASNNEYLGNATESDWVYSGKLKVEDGNLVLTMPKESTGSLIANNHYIWYGKIGAKIKSSRGAGVVTAFILLSDTKDEIDYEWVGSDLKEVQTNYYFQGILDYDNGGKSKVDGGNTYADWHTYEIDWTPEKIDWLVDGEVVRTLTKESTFNETADRYEYPQTPSRMQLSLWPAGQASNAQGTIEWAGGEIDWDSEDIKNQGYYAAYYSDITVECYDPPSDAKVSGDVSYDFKDDKGLESSVEITDNNTVLASLGATGLNMDLGSNKTDSSGNSTGSISNSTVPQNQGGTGNIAGSSTGNGGSSSSDSSGGAFSQGTDDSTDGENAAPSERVLKGSFFAVLVAVVVLIIM

SEQ ID NO: 6037 - protein, 107 aa, Pectobacterium carotovorum subsp. carotovorum
IGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGA

SEQ ID NO: 6038 - protein, 465 aa, Ahnfeltiopsis complicata
AKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDIRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYNTLLLPYLKVNLPQGIFFEQDWASLRKVTPVASGGIHCGQMHQLLDYLGVDVVLQFGGGTIGHPDGIQAGATANRVALESMVIARNEGRDYVAEGPQILQDAAKTCGPLQTALDLWKDITFNYTSTDTADFVETPTANV

SEQ ID NO: 6039 - protein, 507 aa, Oryza sativa (japonica cultivar-group)
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 6040 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIVQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 6041 - protein, 300 aa, Polarella glacialis
RIGRQVARIAMKDPEVELKLVNASYEADYLAYMMKYDSIHGRYDGTVEVDGDSLVIDGHKVALSHTRDPAEIPFAKYGADYVCESTGVFLTTEKIQAHLKAGAKKVVFSAPAKDESHTIVMGVNQETYKPEMQAVSCASCTTNGLAPMVKAINDAFGIKRGLMTTIHAMTASQPTVDGASKKDWRGGRAASGNIIPSSTGAAKACALVIPAIKGKLTGMAFRVPTIDVSVVDLTCELEKATTYEEICAEIKRRANGDMKGYLGYCDESLVSTDFETCPISSTFDAKAGIMLDSTFVKLVA

SEQ ID NO: 6042 - protein, 360 aa, Bacillus subtilis subsp. subtilis str. 168
MRIKEHLKQLKPYQPGKPIEAVKSEYGLDKVVKLASNENPYGCSEAAKEALHHEIQQLALYPDGYSAALRTRLSKHLNVSETSLIFGNGSDEIIQIICRAFLNDKTNTVTAAPTFPQYKHNAVIEGAEVREIALRPDGSHDLDAMLEAIDEQTQVVWICSPNNPTGTYTSEGELLAFLERVPSRVLVVLDEAYYEYVTAEDYPETVPLLSKYSNLMILRTFSKAYGLAALRVGYGIADENLIRQIEPAREPFNTSRLGQAAAIAALYDQAFIASCVEQNNAGLQQYYDFAKTHGLKCYPSQTNFVLIDFKRPADELFQALLEKGYIVRSGNALGFPTSLRITIGTKEQNEEILAILAEIL

SEQ ID NO: 6043 - protein, 194 aa, Xylella fastidiosa Dixon
MLLMLDNYDSFTYNLVQYLQTLGAEVMVIRNDAMTVEQIAALKPERIVISPGPCTPNEAGVSLKLIEQLGSSTPILGICLGHQSIGQAYGGDVVRATNIMHGKTSAIYHNGKGVFVGLPNGYDATRYHSLVVDKTTLPDVLEVTAWTENQDGTIEEIMGLRHREYFVEGVQFHPESILTEHGHGLLKNFLECPL

SEQ ID NO: 6044 - protein, 378 aa, Schizosaccharomyces pombe
MSMLSTLRTAGSLRTFSRSACYSFRFSSTKAAAGTYEGVKNANGNYTVTMIAGDGIGPEIAQSVERIFKAAKVPIEWERVKVYPILKNGTTTIPDDAKESVRKNKVALKGPLATPIGKGHVSMNLTLRRTFGLFANVRPCVSITGYKTPYDNVNTVLIRENTEGEYSGIEHEVIPGVVQSIKLITRAASERVIRYAFQYARQTGKNNITVVHKATIMRMADGLFLECAKELAPEYPDIELREEILDNACLKIVTDPVPYNNTVMVMPNLYGDIVSDMCAGLIGGLGLTPSGNIGNQASIFEAVHGTAPDIAGKGLANPTALLLSSVMMLKHMNLNDYAKRIESAIFDTLANNPDARTKDLGGKSNNVQYTDAIISKLK

SEQ ID NO: 6045 - protein, 344 aa, Arabidopsis thaliana
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGKHPWDLPELDHFMICSLYAAQIRLEVVLLCVHSVNPSEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 6046 - protein, 96 aa, Zea mays
PITFSQLLDRTLPTVCPSKLSYLAEHTLSEQIKELSAYISVPEYRYACGGGLQSLNAWFAPEGTVSPLHHDPDYNILAHGLGRKCIRLYPAFIAED

SEQ ID NO: 6047 - protein, 141 aa, Medicago truncatula
FKDTIDLFVERYKGKNISVVAGIEARGFIFGPPIALAIGAKFVPLRKPKKLPGKVISQEYILEYGRDCLEMHVGAVETGERAIVVDDLIATGGTLGAAMNLLERVGAEVVECACVIELPELKGRERLNGKPLYVLVEYFDI

SEQ ID NO: 6048 - protein, 180 aa, Oryza sativa
MISAKRLVQLAKKWQRMAALGRKRVMAAAQETEECSTSVAVKGHCVMYTADGRRFEVPLVYLGMRVFIELLRMSQEEFGFTSDGRIMLPCDAAEMEYAMCLLKRNASADVVNALLSSMLTSCRYTDWNIAHDVLMTLSPYPAFPTMPNLAGYLLLSNYKSMAKWPPNTITSSTNKALQLR

SEQ ID NO: 6049 - protein, 473 aa, Candidatus Blochmannia floridanus
MNVDYFISFINKNKVKFIDLRFTDIMGKEQHFTIPQSQIDNHFFENGKVFDGSSMVGWKNVHESDMILIPDLTNDHIIVDPFYQDTTVILRCDVLDPHSMQNYDKDPRYISKKSEKFLQDSGIADFAMFGPELEFFVFDDVRFKTSMSGCHVMIDDPEASWNSDKVYFYGNKGHRPKIKGGYSPVPPIDSSQNLRSMMSIMMEKMGLIVETHHHEVATAGQNEIITRFNSLTRKADEVQIYKYIVHNVSNKFGKTATFMPKPIIKDNGSGMHCHISLYKNKVNLFSGDQYGNLSEIALFYIGGILKHTKALNAITNPTTNSYKRLIPGYEAPTFLTYSLSNRSSAIRIPAIINNNPNLCRIEVRFPDPSANPYLAFPALLMAGIDGIINEIHPGNPVNKNLYTLSDLEKEHTLYTSQSLNESLQYLSEDYEFLIRNNVFSKNFIDSYILIHKKMDSLVRSVPHPMEFELYYSI

SEQ ID NO: 6050 - protein, 567 aa, Pseudomonas aeruginosa PAO1
MHHTPLLTTLAAGFVLAFLFGALANRLRISPLVGYLLAGVLAGPFTPGYVADQALSQEIAELGVILLMFGVGLHFSLKDLLSVKAIAIPGALVQIGVATLLGIGLAKLLGWSFGGGLVFGLSLSVASTVVLLRALEQRQLLDTKRGRIAIGWLIVEDLAMVLTLVLLPALAGTLGGKTDGGDAGLLWPLLITLGKVAAFVALMIFGGRRVVPWVLERIAASGSRELFTLAVLAIALGIAYGSAVLFGVSFALGAFFAGMILNESELSHEAAENSLPLRDAFAVLFFVSVGMLFNPMILLQEPLTVLATFLVIVFGKSVAAYLIVRAFGHPNSTALVIAASLAQIGEFSFILIGLGIGLELVPEQSRDLVLAGAILSILVNPLLFIAIDRLQQRKEQRLAEAAGGVREMPAQDLPPPILEREHAVLIGHGRVGGLVSARLRTAGTPFVVVVDKRDKADELREQGYSVVLGNAASPGVLELANIAEARWLLIAIPNGFEAGQIASHARAVNPPLDIVARAHFDAEVDYLEQNGANLVIMGEREIACGMVHRLGLDRDERGADAPLPQSA

SEQ ID NO: 6051 - protein, 357 aa, Synechococcus sp. PCC 7942
MALVPLRLMLDHAAENEYGIPAFNVNNLEQVQSILQAADETDSPVILQASRGARSYAGENFLRHLILAAVETYPHIPIAMHQDHGNSPATCYSAIKNGFTSVMMDGSLEADAKTPASYEYNVEVTRQVVDVAHSIGVSVEGELGCLGSLETGKGEAEDGHGFEGTLDHSQLLTDPDQAVDFVEKTQVDALAVAIGTSHGAYKFTRKPTGEILAISRIEEIHRRLPNTHLVMHGSSSVPQELLELINEYGGQIPETYGVPVEEIQKAIKLGVRKINIDTDNRLAFTAAVREAAAKDPSNFDPRHFNKPAIKYMKQVCVDRYVAFNTAGQASKIKQEGLDEFAAKYAKGELRAQTKVFA

SEQ ID NO: 6052 - protein, 527 aa, Hordeum vulgare subsp. vulgare
MAGDQVHVLAALDGAKTQWYHFTAIVVAGMGFFTDAYDLFCISLVTKLIGRIYYTVPGSPSPGSLPPTVSAVVNGVAFVGTLSGQLFFGWLGDKVGRKSVYGMTLMLMIICSVASGLSFGRTPTSVMATLCFFRFWLGFGIGGDYPLSATIMSEYANKRTRGAFIAAVFAMQGFGILAGGGVAIGITALFRALFPAPPYAADPVASTPDQADYVWRIVLMLGALPAALTFYWRMKMPETPRYTALIAKNAERAAADMSKVLNVEITKEQAGDLETAISIKSHTSPSFGLFSREFMRRHGLHLLGTASTWLLLDIAYYSQNLFQKDIFSAIGWIPPAPTMSALDELYHIARAQILIALCGTVPGYWFTVAFIDSVGRFKIQLMGFFMMTAFMLGLAGPYDYWTGQGHQVGFVVMYALTFFFANFGPNATTFIVPAEIYPARFRATCHGISAASGKVGAIIGSFGFLYLAQSPDPAKTAHGYHPGIGVRYSLFVLALCSLLGFMLTFLVPEPKGKSLEEMSRETEPDHC

SEQ ID NO: 6053 - protein, 538 aa, Zea mays
RPAGPGLTGSIPPQLGNLNKLTVLAMQSNQLAGAIPATLGELTQLRRLDLSFNSLFGSIPSKIAEVPLLEVFDVRNNTLSGSVPVGLRRLNGGFQYMNNKGLCGAGFSLLELCLSSEDGLKPSKPEPFGPDGTVKTRQVPQSANPDGCSGASCSKSANASQGVLIVAVVAAVIGAAFCGLFAFSWYRRQKQKIGSSLEVSDSRLSTDHFQQKEACRRSASPLISVEYSNSWDPLSAGGAGVGSPGQVVGDSFRFNLEEVECATQYFSDVNLLGKSGFAAATYKGILRDGSVVAVKSLSKTSCKQEESDFLRGLKMLTLLQHDNLVSLRGFCCSRGRGECFLVYDFMVNGCLSRYLDVKDGSSGATVLDWPTRVSIIRGIAKGIEYLHSKKGSKPPVVHQNISADKILLDHHLAPRLSVPGLHKLLADDVVFSALKASAAMGYLAPEYAATGRFTDKSDVFAFGVVVLQVLTGRRDVSQLKVGAAAVSDLGGLVDANLDGAFSRTEAARLAAVAAYCTSETPGQRPTMEAVVQQLSSTQ

SEQ ID NO: 6054 - protein, 174 aa, Nitrosomonas europaea ATCC 19718
MSIKSRIRTIPHYPHEGIMFRDITTLLKDPAGLRSTIDGIVQRYQTEKIDKVVGIESRGFIIAAPVAYALSAGFVPVRKQGKLPAETIGCDYQLEYGYDKVEIHVDAIDKGDRVLLIDDLIATGGTMEAAIKLVQEAGGEVIECCFVIDLPDIGGSRRLRQQGHRLFSLCSFED

SEQ ID NO: 6055 - protein, 797 aa, Escherichia coli K12
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKGKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 6056 - protein, 215 aa, Triticum aestivum
  unsure (1)..(215): unsure at all Xaa locations
MEKAGHQHVIGIPVSSTAIGIEEPEFTSDGATYVHGDAKYSTSTRTGGKSGRAGDKFARGIREHVTLGPKLYETVRGKLSLGARILQAGGVENVFRRWFAVEKGEKLLNASQCYLSTTAGPIAGMLFVSSERVAFRSDRSLALTSPKGDTVRVPYKVAVPLSRVKAAKPSENQHRPEQKYVQLVTDDGFEFWFMXFVSYQASLQHLEQAIAESHL

SEQ ID NO: 6057 - protein, 221 aa, Ralstonia eutropha
MIPMTQKLTFTRFVIAEQHGSKTVDSDLIALLLDVSIACRKIASSIAKGSPLALGGEAAGRDVPGEIQSKTDMATPCFFARSEALARHLAGMASEGMEGAYPVPLRSPQGRYLLVCDPLDGSANIDVNVSGGIIFSVLRCPEGISAPEERDLLQAGSAQMAAGYALYDAPALLVLKTGSGIHGFTLDADSGQYVLTHPNAKIPQVPAGSRSALRPSTSGQS

SEQ ID NO: 6058 - protein, 172 aa, Escherichia coli
DAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIAND

SEQ ID NO: 6059 - protein, 477 aa, Myriogramme sp.1
KNDRYESGVIPYAKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKALGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 6060 - protein, 512 aa, Debaryomyces occidentalis
MRFSTEGFTSKVVAAILAFSRLVSAQPIIFDKRDVGSSADKWKDQSIYQIVTDRFARSDGSTTADCLVSDRKYCGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQSYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVSAGDFGSLSVSISGGMPQVYAPSSVLSGSGICNQ

SEQ ID NO: 6061 - protein, 284 aa, Triticum aestivum
MACTHLAAASSPATTAAALRARATAPAAGFARLPATLHPENGGLALRGRRAVTPVVLAAGPAAAAPVADRDGTPAAVKQPIIVIDNYDSFTYNLCQYMGELGLNFEVYRNDELTIEEVKRMKPRGILISPGPGEPQDSGISLQTVLELGPTIPIFGVCMGLQCIGEAFGGKIIRVPSGVMHGKSSPVYYDEVLGKSIFEGLSNPFTAARYHSLVIEEETFPHDELEVTAWTEDGLVMAARHKKYTHIQGVQFHPESIITPEGKKIILNFARYVEEFEKQTSEGK

SEQ ID NO: 6062 - protein, 226 aa, Haemophilus somnus 2336
MQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 6063 - protein, 401 aa, Neurospora crassa
MSPFNLETCARPNILALEPYRCARDDYKDDGTNILLDANENAYGPPVPQNLATGSGSSGPELDLLGLHRYPDPHQRDLKQLLCSLRTTHAHTSKLLTPENLCVGVGSDEAIDALLRCFCVPGRDRILVCPPTYGMYSVSAQVNDVGLVKVPLLPAPSFAIDVPRVLETLSTEPNIKIIYLCSPGNPTGSLLAKEDIQKVLEHPTWNGVVVVDEAYIDFAPESASLAEWVNEWPNLVVMQTLSKAFGLAGIRLGAAFTSPPIARLLNSLKAPYNISSPTSALASYALGPDGLKVMRANKERLIKQRERLVAELPQIPGVGKLAGGESSNFLLYEMLDKEGKPSNETALKVYQKLAETKGVVVRFRGKEHGCEGCLRITVGTEEEVTRCLGALREALKEVRGE

SEQ ID NO: 6064 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 6065 - protein, 292 aa, Pyrococcus furiosus DSM 3638
MKVRKAVIPAAGLGTRMLPITKSMPKEMLPIVDRPAIHYVVEEAIKAGIEDILIITGKGKRAIEDYFDRSFELEYYLRERGKFEELKQVEEIGEMVDIYYVRQKKPLGLGDAILHAEKHVNGEPFAVLLGDDIIISKKPAIKQLMEVAERKNTSVIGVEKVPWELVSRYGIINGQKIDEQLYTITDMVEKPSPDEAPSNMAIIGRYVLIPEIFDFLKETPPGKGGEIQLTDALRAMLNEYEMLAKVISGRRYDIGTRIGFIKANIELSLLRDDLREGVILFIKNILQEVQDE

SEQ ID NO: 6066 - protein, 331 aa, Oryza sativa
  unsure (1)..(331): unsure at all Xaa locations
MGLWEWPWDRRRRGPSGLGPTSTAEEVTAGVDATHLTAIVTGATNGIGRETARVLARRGAEVIIPARTMESGNAVKQSIAEEVPGSRLHVMEMDLASLDSVRRFATAFDSSHTHLNILINNAGIMGCPFKLSKDGIELQFATNHVGHFLLTNLLLDKMKSTARKTGVQGRIVNVSSIAHKRSDGSCFDLNKLNDKSRYKPLIAYAHSKLANILHANELAKRFQEEGCNLTANSLHPGVILTNITRYVVTNSNVXKPFFSYYYLSNFLQGAATTCYLALHPELKDVSGKYFADCKEATPRPAARDAELAKRLWDFSEQLVDTNRRGEFNRQK

SEQ ID NO: 6067 - protein, 502 aa, Trichodesmium erythraeum IMS101
MPDSYLPKDSYYQETKIYQNDTSDNEQENYQVSERQKTLDVNQIEQKIEVVEKKKFQDIYDGRRCKAALMLWLIWTTTIILHLLSWGYWIILGLTGLLSVQFLRILFAKPKLAPKTLSEENFTEWPYISLLVAAKNEEAVIRKLVKNMLALDYPTNSYELWVIDDNSTDKTPLLLEQLAREYEQLKVIRRSPDAGGGKSGALNAAIPFVKGKILGVFDADAQVTPDLLQKVVPLFAREEVGAVQIRKAIANAGINFWTKGQSAEMVVDGFFQEQRIAIGGIGELRGNGQFVRMNALEECGGWNEQTITDDLDLTIRLHLNQWDIDYLAFPAVTEEGVTSPIALWHQRSRWAEGGYQRYLDYWKLILRNRMRFSKTWDLWQFLVTQYLLSVAAVPDFLMSIILRRLPITSPLTVFTVMVSLLGMFIGLRRTRKQQMNLAKEEKVMEFNSSKDNPLSLFLTLLESVRGTFYMLHWFVVMGVTIARMSILPKRLKWVKTVHRGDE

SEQ ID NO: 6068 - protein, 336 aa, Anabaena variabilis
MIRVAINGFGRIGRNFARCWLGRENSNIELVAVNDTSDPRTNAHLLNYDSSLGVKKVDITADDNSITVNGKTIKCVSDRNPENLPWKEWEIDLIIESTGVFTSKEGALKHVNVGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKRVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 6069 - protein, 180 aa, Zea mays
MARLLLVVLALHLTAARAFAASSVGGRNGDFDPSRVVQLSWHPRAFLHKGFLSDAECDHMIELAKDKLEKSMVADNESGKSVQSEVRTSSGMFLEKRQDEVVARIEERIAAWTFLPSENGESIQILHYKNGEKYEPHYDYFHDKNNQALGGHRIATVLMYLSNIEKGGETIFPNAEGKLT

SEQ ID NO: 6070 - protein, 571 aa, Buchnera aphidicola str. Sg (Schizaphis graminum)
MEILSGAEMVIRSLINQGIQHIFGYPGGAVLDIYDALKTVGGVEHILVRHEQAATHMADGYARSTGKIGVVLVTSGPGATNAITGIATAYMDSIPMVVISGQVASSLIGYDAFQECDMIGISRPIVKHSFLVKRTEDIPIIFKKAFWLASTGRPGPVVIDLPKDILKKTNKYNFIWPKNIHIRSYNPTTKGHQGQIKKALRILLKAKKPIIYAGGGIISSNSSEELRIFAEKINCPVTTSLMGLGAFPGNHIQSISMLGMHGTYEANMAMHYSDVIFAIGVRFDDRTTNNLKKYCPNATILHVDIDPTSISKTVSADIPIVGDAKQVLKEMIELIKKEKQIHSLKEWWSSIGKWKKIKSLEYNKKSNKIKPQKIIQTLFKLTKGTSYITSDVGQHQMFTALYYQFNKPRRWINSGGLGTMGFGLPAALGVKLALPKATVICVTGDGSIQMNIQELSTARQYNLAVLILNLNNSSLGMVKQWQDMIYSGRHSHSYMDSLPDFVKLVESYGHIGLKVKTNEELEEKLILALKKLSEGNLVFLDIQIDDSEHVYPMQIQGGGMNEMWLRKKEVS

SEQ ID NO: 6071 - protein, 353 aa, Triticum aestivum
MATTVQPHSPDPTAITTTPAPPPPPSPPRQENPTAAGEGVEIAALDEQPAAVAVAVADKGKTAPGGGKLVAEAMRKCAAPRSSRYHGVTRLKWSGKYEAHLWDNTSQVEGRKRKGKHVYLGSYVTEENAARAHDLAALKYWGITQPTKLNFNISDYAKEIEIMKSMNQDEFVAYIRRQSSCFSRGTSSYRGVTRRKDGKWQARIGRIGESRDTKDIYLGTFETEVEAAEAYDLAAIQLRGVHAVTNFDISNYSEEGLKKLEGSSEVVNLEDQSEVTKLAVTNLDISKHCEDGLKKLDGASQVVNLEGQSEVTKLSVTNFDISNCCEDGLKKLEGSSEVANLEDQSEVTKLAGQ

SEQ ID NO: 6072 - protein, 348 aa, Saccharomyces pastorianus
MSIPETQKAIIFYESNGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQEYATADAVQAAHIPQGTDLAEVAPVLCAGITVYKALKSANLRAGHWVAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 6073 - protein, 540 aa, Zea mays
  unsure (1)..(540): unsure at all Xaa locations
MAPCSGLWGGKAGGDAYRGTPVVVKMENPNWSISEISSPEDDDDDEDILAAAGGRRRKGARTKNAKQIRWVLLLKAHRAAGCLASLASAAVALGGAARRRVAAGRTDADADADAGVLAVAGESPVVRSGFYALIRAFLVVSLLLLAVEVAAYINGWDLAASALALPALGLESLYASWLRFRAAYVAPGIQFLTDACVVLFLVQSADRLILCLGCFYIRVKRIKPEPKSPALPDAEDPDAGYYPMVLVQIPMCNEKEVYQQSIAAVCNLDWPKSSFLVQVLDDSDDLLTQALIREEVAKWQQQGARIVYRHRVLRDGYKAGNLKSAMSCSYVKDYEFVAIFDADFQPQPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKVLLQYSFYIMILYQLPRLYFLPXYEHNLPCILVIIVYGSLLSDLAA

SEQ ID NO: 6074 - protein, 554 aa, Zea mays
TGLEFPGRPTRPPTRPPTRPHTHHTTPPRFHSARLTSRPVLSFRSLASPDDGHRRGVGRREARQASRRGRQARPDQASAPLLSALDLAARSLRLPFLLISECVFPRSENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 6075 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVTRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 6076 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 6077 - protein, 167 aa, ASPERGILLUS NIDULANS FGSC A4
MPDASSELIDEIGIVKIFRCFSPDIETARICIKVPSTREGLIACRTLEMAGVRTLATTLFTFVQAALAAEVGCTYIAPYVNQLKVHFESGFVDPQKLLPLCVSAQNYYEAIGVRTQVLPASLTSTDEIFALAGAHHITIALSLLQQLSLPLYPRLCSTLNRRVQVPK

SEQ ID NO: 6078 - protein, 243 aa, Prochlorococcus marinus str. MIT 9313
MRKPVIAGNWKMHMTCAQAREYTAMFLPLIEATPNDRHVVIAPPFTAISSMAESVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRRWVGASELIIQYGGSVKPGNIDELMAMSDIDGVLVGGASLDPESFARIANYQTS

SEQ ID NO: 6079 - protein, 198 aa, Streptococcus gordonii
GIEDILVVTGKSKRSIEDHFDSNFELEYNLKEKGKDDLLKLVDETTGIGLHFIRQSHPRGLGDAVLQAKAFVGNEPFVVMLGDDLMDITNDKAMPLTKQLMNDYEATHASTIAVMQVPHEEVSSYGVIAPQGEGLNGLYSVEKFVEKPSPEEAPSDLAIIGRYLLTPEIFKILENQAPGAGNEIQLTDAIDTLNKTQR

SEQ ID NO: 6080 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTELQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 6081 - protein, 361 aa, Oryza sativa
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAADVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 6082 - protein, 875 aa, ASPERGILLUS NIDULANS FGSC A4
MADSENPQAASNSASSLVTVLVPSLVVAGAMVLIFVILRRSERRMYMPRTYLGVLRDSQKTPPSSTGPLGWIKDMYKLPDEYVLQHHSMDAYLLLRFLKIITMICFVGSCLTFPILFPVNATGGAGKQQLDILSFSNVSETKYARFFAHALVAWVFVAFVFFTVTRESLFYINLRQAYSLSRSYASRLSSRTVLFTTVPEEYQSVEKIRFMFGANKVKNVWLTTDTAELAEKVNDRHAAAIKLEAAETKLIRMANAARLKALKKNRGTGEQSTAPEATEDDGESGSVAARWVRPKDRPTHRLKPIIGKKVDTINWARSEIERLTPEIEALQTQHRAGEAKLVSSVFVEFHTQADAQAAFQSVAHNLPLHMAPRYIGLEPTQIIWSNLRIKWWERIIRYGASVAFVSAMVIFWAIPTAFVGSLSNINNLTDKVHFLRFINDVPDWILGAITGLLPTILMAVLMALVPIVLRLMAKIGGAPNLAAVELSTQNFYFFFQVVQVFLVVTLSSAATSVVTKIVSNPTSATSLLANNLPLSANFYISYIVLQGLSFSSGALLQISGLILGKILGRLLDNTPRKMYSRWSNLAGLGWGTVYPVFTLLAVIAITYSCIAPLVLGFATIGLYLFYFAYRYNLLYVSNADIDTQGKTFARALQQILVGCYLLVVCLIGLFAIGTGTDPIALGPMILTIILLVTMIIYHVSLNAALDPLINYLPRNLEAEEEALLSQETNGAKDEYDGSASPSAADGQTADNVDSAEKGLTQANPAEPKTNFLTKYLRPDKYSGYRQLRTLVPNGTETVSYPPEVERNAYYHPAISAQAPLLWIPRDEMGISAQEVAHTSRVIPITDEDAWLDEKNHIVWNVEKGVPPIFEEKIYY

SEQ ID NO: 6083 - protein, 319 aa, Triticum aestivum
  unsure (1)..(319): unsure at all Xaa locations
PFAVPAEYHRFPLPPSSSAPAAASRGSAGGDVEEGIVITTPLKRKAPXRESDAIESTEWMITSPGFTEGVSRPRMTPGSGKAARTYKSKAKGSKDGLQTPISNAGSPGTPLTPGSSRAEHSLGELTKKCISLLKHAEDGILDLNNVAEILVVKKRRIYDITNVLEGIGLLEKXLKNRIRWEGLDDSXANLDNEISILETELENLKLQEKALDNRISEMHEKVRELTEEENNQRWLYLTEDDIKGLPCFQNETLIAIKAPHGTTLEVPDPDEAGDYVQRRYTIVIRSTMGSIDLYLVSKFEENMEELVGVTTPPRHANVA

SEQ ID NO: 6084 - protein, 292 aa, Neisseria meningitidis MC58
MNYAKEINALNNSLSDLKGDINVSFEFFPPKNEQMETMLWDSIHRLQTLHPKFVSVTYGANSGERDRTHGIVKRIKQETGLEAAPHLTGIDASPDELRQIAKDYWDSGIRRIVALRGDEPAGYEKKPFYAEDLVKLLRSVADFDISVAAYPEVHPEAKSAQADLINLKRKIDAGANHVITQFFFDVERYLRFRDRCVMLGIDVEIVPGILPVTNFKQLGKMAQVTNVKIPSWLSQMYEGLDDDQGTRNLVAASIAIDMVKVLSREGVKDFHFYTLNRSELTYAICHILGVRP

SEQ ID NO: 6085 - protein, 480 aa, Oryza sativa
MAAGAIPMAYQTTPSSPDWLNKGDNAWQMTSATLVGLQSMPGLVILYGSIVKKKWAINSAFMALYAFAAVWICWVVWAYNMSFGDRLLPFWGKARPALGQSFLVAQSELTATAIRYHNGSAEAPMLKPLYPVATMVYFQCMFASITIIILAGSLLGRMNIKAWMAFVPLWITFSYTVCAFSLWGGGFLFQWGVIDYSGGYVIHLSSGIAGLTAAYWVGPRSASDRERFPPNNILLVLAGAGLLWLGWTGFNGGDPYSANIDSSMAVLNTHICASTSLLVWTILDVFFFGKPSVIGAVQGMITGLVCITPGAGLVQGWAAIVMGILSGSIPWYTMMVLHKKWSFMQRIDDTLGVFHTHAVAGFLGGATTGLFAEPILCSLFLSIPDSKGAFYGGPGGSQFGKQIAGALFVTAWNIVITSIICVIISLILPLRIADQELLIGDDAVHGEEAYAIWAEGELNDMTHHNESTHSGVSVGVTQNV

SEQ ID NO: 6086 - protein, 468 aa, Phyllariopsis brevipes subsp. brevipes
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGTNFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVSEGPEILRNAASTCGPLKAALDLWKDITFDYTSTDTPDFVEVPTESN

SEQ ID NO: 6087 - protein, 365 aa, Zea mays
MEPQCNVGMFTRAELLEASVELRHHALGCVKSTALRCAVKLGVANAIQRRGGRASVEDLLTELSLDASRLRCLHSVMRALAALGVFKEGSDGEYGLTAISSLLVDDDSSVRGSLRPITLLYLEPAFVAPVLNLADWALAGVDGSDDDNNCSARGTAFKMTHGEDVWDVLARDAFLGDFFNGALASETRFLMDIAIRGSPQVFEGIASLVDAGGGTGAAAQAVAAAFPDTRCTVLELPQVVDAAPIDGPVRFVGGDMTKFIPPADAVLLKNVLHDWSDKDCVIILKRCKEAIAASGKVIVIDIVLGSSSLAICNETQLWLDLFMSTVTTGKERREEEWYRLFKEAGFSAYKICPVLGLLSVIEVFL

SEQ ID NO: 6088 - protein, 502 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGDLTKEDLDMSEAVGITVHMKFPLQLVAKRHLS

SEQ ID NO: 6089 - protein, 353 aa, Botryotinia fuckeliana
MGCGMSTEEKEGKARNEEIENQLKRDKMLQRNEIKMLLLGAGESGKSTILKQMKLIHEGGYSRDERESFKEIIFSNTVQSMRVILEAMESLELPLDDQRAEYHVQTIFMQPQQIEGDNLPPEVGSAIAALWKDAGVQDCFKRSREYQLNDSARCYFDNIERIAQHDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYALACDYILNRFVSLNQHETKQIYTHFTCATDTTQIRFVMAAVNDIIIQENLRLCGLI

SEQ ID NO: 6090 - protein, 127 aa, Nostoc sp. PCC 7120
MDLIVEDLAAIDNKLSQRHIDLDPNGYFIIYIDKTAGLIYAKHFTNIIDERGLAVDPETGKVIPARGKVERTYTTVFAGRTAKELCVKIFEETQPCPVTMLDHAAYLGREFVRAEVALVAGQEYVQD

SEQ ID NO: 6091 - protein, 105 aa, Zea mays
  unsure (1)..(105): unsure at all Xaa locations
LPLFPSDLYTLFDGFDILNSFRANPPXPGIELGPEFKKVDKYLARIKYIPSIGELDTLNGSCDGXAGSGMTLKGXVTISAKPSTKLLIXEGNVLENKDVNGPEDL

SEQ ID NO: 6092 - protein, 483 aa, Rickettsia sibirica
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPAVSFHPFTRTLHPNLNLTIIRENEEDLYAGIEYRQTHNMYESMKLISHTGCEKIIRYAFEYAVKNNRKKVMCLSKDNIMKFSDGILHKVFNEIAKEYPQINNAHYIIDIGTARLATKPEIFDVIVTSNLYGDIISDLAAEISGSVGLAGSANIGQHYAMFEAVHGSAPDIAGKDIANPSGLLNAAIMMLVHIGQGDIATLIENAWKKTIEDGVHTADIYNEQSSSKKVGTKEFAAEVTKRLGQLPTKLPKADYPLIAEKQESNIDYKIDTKEVKKLVGTDIFVNMNVSAAHDIADKINKLDLGNFELKTISSKGLKLWPRDTRFETVSDHWCCRFMNKDGTEIKHLDITRLLEALSTANIDFIKVENLFEFDGVAGYSLAQGE

SEQ ID NO: 6093 - protein, 334 aa, Kluyveromyces lactis
MSEPSAKKQKFANSLEALKATGTTVVADTGDFESIAKFTPQDATTNPSLILAAAKQQAYAKLIDSAVQYGKKQGQNIDEQVEIAVDKLLVEFGTAILKVVPGRVSTEVDARLSFDKDATVKKALEIIKLYEAEGISKDRVLIKIASTWEGIQAAQELEKEHDIHVNLTLLFSFAQAVAAAEANVTLISPFVGRILDWYKASTGETYTAETDPGVISVKSIYNYYKKHGYNTIVMGASFRNVGEIKALAGVDFLTISPKLLDELLSSDEPVAKILDPESAKAEGSERVSFINDEPKFRFELNEDAMATEKLSEGIRKFSADIVTLFDLIKAKIQA

SEQ ID NO: 6094 - protein, 452 aa, Zea mays
  unsure (1)..(452): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLXAVCKAGAMVKKIPLYQHIANLAGNKTLVLPVPAFNVINGXGSHAGNKLAMQEFMILPTGASSFKEAMXMGGLKVYHNLKSIIRKKYGQDATNVGDEGGFAXPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRXVAKAINEKTCNALLLKVNQIGSVTESIEAVRMSKRAGWGXVMASHRSGETEDTFIADLSVGLSTGQIKTGAPCRSERLAKYNQLLRIEEELGDAAVYAGAKFRAPVEPY

SEQ ID NO: 6095 - protein, 331 aa, ASPERGILLUS NIDULANS FGSC A4
MQSVLQPIIGPKKTAEDLSGRVAIITGGAFGIGYEISRTFVQNGARVIMVNRKEDQGQEAIDKIKEEAGSDAKIEWVPCDMGNLAQIREVASRFVEKEERLDLLILSAGINVHQYGETHDKIERHFQVNWLGQFYLTNLLWPLLRKTAKLPDTPAPRVVFESSEQHRAAPSGVKFGSLEEINNPDLGPLERYGRTKLAIILGVKYGLLEKVIKPNGDNIYALSVHPGAVNTAMQQQWKDAYPGLFGKLLTTVMLAAGRNVEQGSYSALYAAISPEVEEKGWNGYYLKDVGQPGKESSLASDSVLGAALWDLSHRMIRDILGNDAVADWASA

SEQ ID NO: 6096 - protein, 590 aa, Neurospora crassa
MVLHQFDYLLAIGTIFAALDAWNIGANDVANSWATSVAARSVTYLQAMILGSIMEFAGSVGVGARVADTIRTKVVDTTLFADDPALLMLGMVCAVVASSIYLTMATRFGLPVSTTHSIMGGVIGMGIAAVGADGVQWVGSSINDGVVSVFLAWVIAPGLAGAFASIIFLVTKYGVLLRSNPVYKAFVMVPIYFGITAALLCMLLLWKGGSYKVTLTNPEIAGTIIGVGAAWALLVTIFLMPWLYRIVILEDWQLRFWHIPLGPLLLRRGEVPPPPADGSGVVQDFYAGRLTKEQLAARRAAQNGDSEMAAGAVTSSTSNPSAPTDGEKGATITKDDSSYSHDHSEPAQAAQPQIKTMVGPRPAGPWHSGAVLFWYVKWALFRGVDQDVLSSQQEKSVISSDVEELHAHATHYDNKTEYMYSFLQIMTAAAASFTHGANDIANAIGPYATVFQLWKDGALPEKGKADVPVWILVFGASCLVIGLWTYGYNIMRNLGNRITLQSPSRGFSMELGSAVTVILATRLKLPVSTTQCITGATVGVGLCSGTWRTINWRLVAWIYMGWFITLPVAGIISGCLMGIIINAPRWGYSG

SEQ ID NO: 6097 - protein, 399 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEVYEYITYDANKHISLASLPGMQERTIITSSLSKTYSVTGWRLGWACAAASIASAIRNIHIKLTDSAPAPFQEAALIALTSTADYYISLRKDYEVKRDFILLLLKDLGFKISVKPQGSVFVFAELPRSCQLSDVEFVTKLINDAGVVAVPGRGFFHKTCDGESYCHRYVRFAFCKGDDTLKAAAMKMRKLASRQGEPWLTGRQ

SEQ ID NO: 6098 - protein, 432 aa, Triticum aestivum
  unsure (1)..(432): unsure at all Xaa locations
MTHGPTSLLPGRARTTARSPSSRRQSLHATTAEAMDGEDAHHRPSSSSSSGGPFLSGLCAAALRRKPISARASAAASGEGLVRQLGVLELVLLGIGASIGAGIFVITGTGARDAGPGVTISFALAGAACVLNALCYAELASRFPAVVGGAYLYTYAAFNELTAFLVFTQLMLDYHIGAASIARSLASYFIQFLELIPSVKGNVPSWIGHGEEFFGGVVSVNILAPILLVILTVILCRGVKESSAVNTFMTTLKIIIVIVVVFAGVFEVDVSNWSPFMPNGFKAVVTGSTVVFFAYVGFDAVANSAEEAKNPQRDLPIGILGSLLACVILYVAVCLVITGMLPYTLLGEDAPLAEAFSAKGLKFVTVLISIGAVAGLTTTLLVGLYVQSRLYLGLGRDGLLPSXFTKVNSRFHAQLSFLIWXGCVAAFLAGPL

SEQ ID NO: 6099 - protein, 724 aa, Azotobacter vinelandii
MLEGRLLGGGADAVEDHPAGIGQQHGVGAAGQLQVEVVHFAAGDLQHPLQALAALQQVTVLQHAGRQRLRRVELVLLQAAQPGAGDRGIVGRSDGLSLGQGFHLMNMAKHAVRLHCHCCLRSDRRAAPVLTPQHRPAGAALQWRHVRRRPILPSGQDKMSHPCFNPVTGYPVPPPKSCGESAQALGSWHSGTPLAVSIRRRALAHSPERQNHKNQENSMRYAHPGSEGAIVSYKVRYGNYIGGQFVPPVKGQYFTNSSPVTGEEFAEFPRSTAEDIEKALDAAHAAAGAWGRTSVQERAAVLLKIADRIEQNLEVLAVTETWDNGKPVRETLNADVPLSADHFRYYAGCIRAQEGSAGEINENTVAYHFHEPLGVVGQIIPWNFPLLMAAWKLAPALAAGNCIVLKPAEQTPLSITVLVELIGDLLPPGVLNIVQGFGREAGEALATSKRIAKIAFTGSTPVGAHILKCAAENIIPSTVELGGKSPNIFFEDIMQAEPAFIEKAAEGLVLAFFNQGEVCTCPSRALIQESIYDDFMKVVMKKVGQIKRGHPLDTDTMVGAQASSQQFEKILSYLEIARSEGAEVLTGGAAERLEGSLASGYYIQPTLLKGHNKMRVFQEEIFGPVVGVTTFKDEAEALAIANDTEFGLGAGLWTRDINRAYRMGRGIQAGRVWTNCYHLYPAHAAFGGYKKSGVGRETHKMMLDHYQQTKNLLVSYDINPLGFF

SEQ ID NO: 6100 - protein, 390 aa, Zea mays
  unsure (1)..(390): unsure at all Xaa locations
MAHQVAGVGGKDHRELQAQHTTADTEELLAAHRELWSHALGYVKSMALKCALDLGIPDTIQRYGGGATVGELAAASNLPASSLPFLRRLMRTLTAMRIFAVHRDDDPSDDPADDAAAVVSYQLTATSRLLVNGGSYFSIRPNISAIVHQGAVSPMFSMSEWMKQHHHHAPDMTLHEMVHGEPVWESFRANPAIRAWFYDAMDADARLVMHVVLSECPAVFHGLASLVDVXGGGHGTAAAAIARAFPHIKCTVMDLPHVVAEAPAGTGLCFLAGDMFDHIPPADGILLKWILHDWDDAKCIKIMERCKEAIGGKERGGKVIIIDTVIGSRPNEEDMIRREAQVLCDLGMMTTSNGAEREEHEWRRIFLAAGFRDYKITDTRGIPSIIEVYP

SEQ ID NO: 6101 - protein, 614 aa, Sorghum bicolor
MGMGSDAAAVLFPFSTTTTTTSPRLCGTAVSSHRRIFSDVAEDVTVSVDGQSFLLHKFPLVSRCGRVRKMVVDSKDPDLLKLELVNVPGGAFAFELAAKFCYGSNFEITTGNVAHLRCVAEYLEMTEDYQEENLIFRTETYLNEIVLKNLDKSLEVLCKCDGLDPVVEEVGLVDRCVDAIAVNASKEQLVSGLAHLECDVGSAKLRMHCQDWWVEDLSALRIDHYRRVIAAMRRNGVRPESIGTSITHYAQTSLKGVERRHVWDSGPFVGDSQRMIVETLIDLLATENITTVTLSFLFGMLRMAIEVDASLDCRIEVEKRIGLQLEMASLDDLLIPSTQTSDSMFDVDTVHRILVNFLQRIDEDSSGELSPCGYDSDGLKSPSHSSVLKVGRLMDGYLAEVAPDPYLKLQKFMALIELLPDYARIVDDGLYRAIDIYLKAHPSLTESECKKLCKLIDCQKLSQDASSHAAQNDRLPIQMVVRVLYFEQLRLKSGVPSSCVSPQRDNYASLRRENRELKLEISRMRVRLTELEREQGLMKQQGRMRGGDGGGRHGGEQGRAFLASLSRGFGRITMFGVGGGPAAADRRRKKSGGRSSQCSDGKARRRHKASFAYD

SEQ ID NO: 6102 - protein, 327 aa, Azotobacter vinelandii
MRAMLLERVGHPLVLRELPTPQPGPGEVRVRVGACGVCRTDLHVVDGELPAVNPPVIPGHEIVGRVDAVGPGVEGFALGQRVGIPWLGHTCGHCWYCRHEAENLCDAPQFTGYTRPGGYAEQVVADARFTFALGEDGDDVALAPLLCAGLIGWRSLVKAGPARRLGLYGFGAAAHIVMQVARWQGREVYAFSRPGDLAAQDFARSLGAAWAGGSDQLPPEPLDAAILYAPAGELVPTALRALRKGGRVVCAGIHMSDIPSFPYDILWEEREVVSVANLTRQDGLDFFAVAEQAGIRTETHRYALEDANRALDDLRHGRFQGAAVLVP

SEQ ID NO: 6103 - protein, 425 aa, Shigella flexneri 2a str. 301
MTRRGKCRGALPSDTLSRGFRMGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDP

SEQ ID NO: 6104 - protein, 337 aa, Geobacillus stearothermophilus
MKAAVVEQFKKPLQVKEVEKPKISYGEVLVRIKACGVCHTDLHAAHGDWPVKPKLPLIPGHEGVGVIEEVGPGVTHLKVGDRVGIPWLYSACGHCDYCLSGQETLCERQQNAGYSVDGGYAEYCRAAADYVVKIPDNLSFEEAAPIFCAGVTTYKALKVTGAKPGEWVAIYGIGGLGHVAVQYAKAMGLNVVAVDLGDEKLELAKQLGADLVVNPKHDDAAQWIKEKVGGVHATVVTAVSKAAFESAYKSIRRGGACVLVGLPPEEIPIPIFDTVLNGVKIIGSIVGTRKDLQEALQFAAEGKVKTIVEVQPLENINDVFDRMLKGQINGRVVLKVD

SEQ ID NO: 6105 - protein, 413 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 6106 - protein, 394 aa, Corynebacterium glutamicum ATCC 13032
MSRSPEQHLAEISALLPPQKSTFVNLREALGRRTFSAVTAQWDSPRFDNSQMDGFALGPSHLNGGTFAVGPTIPAGHDPDQWYPRGIEKDIAPIMTGARLPKNTAAIIPVEKTTPGNFDAPQVEIPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLFVAPALNRQPLRHLDARITAPVQGLQDNREQFLRGTISYRNGHVLATPLLGTSSHLLVQAATADCLIRIPARTTVEENDIVKIYPFN

SEQ ID NO: 6107 - protein, 256 aa, Glycine max
  unsure (1)..(256): unsure at all Xaa locations
MEGSVNERLDFGKMGYGCNHYRRRCRIRAPCCNEIYSCRHCHNDAASLLKNPFDRHELVRQXDVKQVVCSVCDTEQPVAQVCTNCGVKMGEYFCNICKFFDDDXEKEQFHCDDCGICRCGCXDTFFLRNNHLCVEKSMRHHCPICYEYLFDSLKDIVVMKCGHTMHNECYLEMIKSDKYCCPICSKSVMDMSRTWKRIDEEIEATVMPDDYRYRKVWILCNDXNDTTEVYFHFLGQKCGHCRSYNTRAIAPPVLPQ

SEQ ID NO: 6108 - protein, 130 aa, Salmonella enterica
MFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 6109 - protein, 483 aa, Burkholderia sp. RP007
MDTQLIIDNADVPATAAATFERRSPTTGELVTRAAAASVADAIAAADSAAAAYRSWSTTGPTERRRILLKAADLLEARTPEFSRVMALEVGASDLWAGVNVMLAANLFREAAALTTQIQGETIPTDKAGVLSMTVRQPVGVILSIAPWNGPVVLAARAIAYPLVCGNTVVFRASELSPKTHMLIVDVLRDAGLPPGVLNAVTNAPQDAPEVVDALIAHPAVRRINFTGSTRVGRVIAEKAARHLKRCLLELGGKAPLVVLDDADIDEAVKAAVFGAFLYQGQICMSTERIVVDEKIADTFVARFAARARELPVGDPATCGGCVVGPMIVRESGDRINAMINDAVNQGANVVAGGFADGAVMPATIVDRVTPAMRIYDEETFGPITTVVRAKDADDAVRIANDTAYGLSSAVFGRDVTRALSVAMRIEAGSCHINGSTVQNEAQAPYGGTKASGYGRFDGRAVIDEFTELKWITIEPTPQSYPF

SEQ ID NO: 6110 - protein, 488 aa, Mastocarpus papillatus
MSNSVEERTRIKNERYESGVIPYAKMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGALDFLKDDENINSQPFMRWKERYLYAMEGVNRSVAASGEIKGHYLNITAATMEEMYERAEFAKQLGTIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGALQTALDLWKDITFNYTSTDTADFVETPTANV

SEQ ID NO: 6111 - protein, 225 aa, Arabidopsis thaliana
MVSPKIAPSMLSSDFANLAAEANRMIDLGANWLHMDIMDGHFVPNLTIGAPVIESLRKHTNAYLDCHLMVTNPMDYVAQMAKAGASGFTFHVEVAQDNWQQLVEKIKSTGMRPGVALKPGTPVEQVYPLVEGTTPVEMVLVMTVEPGFGGQKFMPDMMDKVRALRQKYPTLDIQVDGGLGPSTIDTAAAAGANCIVAGSSVFGAPEPGDVISLLRTSVEKAQPTT

SEQ ID NO: 6112 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 6113 - protein, 575 aa, Arabidopsis thaliana
MQSDDGHWPAENSGCMFFNAPFNDDGGWGLDVESHSSMFCTVLNYICLRIMEVDPDHDRKKSACARARKWIIDRGGATYTPLFGKACLSKFVATPTPLILQLRQELYPQTYADIVWSQARNRCAKEDLYYPQTFVQDLFWKSVHMFSENILNRWPFKKLIRERAIRRALELIHYHDEATQYITGGGVPKVFHMLACWAEGPESGYFKKHLARVSGFIWISEDGLKIQSFGSQIWDTVLLLKVMLAADIDDEIRSMLIKGYSFLRKSQLIENPPGYYIKMFRDISKGGWGFSDKDQGWPASDCTSESLECCLIFESMPSNFIDEKMDVERLYDAVNMLLYLQSENGGKAVWERASGKKWLEWLSPIEFMEETILEHEYVECTGSAVVVLTRFMKQFPRHRTKEIETFIAKAVKYIESLQMADGSWYGNWGVCFIYATFFAVRGLVAAGKTYQSYEPIRRAVQFLLKIQNDEGGWGESFLSCPGKKYISLEGNKTNVVNTGQAMMVLIMSGQMERDPLPVHRAAKVLINSQMENGDFPQQELRGVYKMNVLLHYPTYRNIFSLWALTYYTKALRLLL

SEQ ID NO: 6114 - protein, 246 aa, Triticum aestivum
  unsure (1)..(246): unsure at all Xaa locations
MGGGNDGHGYPPGGQGGYPPLCYPPQQGGYPPQQGYPPAPGAYPPAPGAYPPAPGAYPPAPGAGGSDGEKGLLSNIMHGVAGAHGGGHGYPSGGHGYPPQQHGYPQQGYPPQHGYPPQQHGYPPQQHGYPPAGYPGSSGHSGSHXRRGMGMGGMLAGGAAAAAAAYXAHKIXHAGNGGVEHDGQHDGRPWRYGGGNATNGQVKDGSTATAVQHGRWEGKHGHGKFKHGKHGKHGXIASGGQFKKWK

SEQ ID NO: 6115 - protein, 302 aa, Halobacterium sp. NRC-1
MATETDLEELRRGSELVKRGFAKMQKGGVIMDVVNREQARIAEDVGAVAVMNLEAVPADIRKRGGVARMADPASLTGIIEEVSIPVMGKSRIGHRKEAEILQAVGADMIDESEVLTPADDEYHIDKREFTAPFVCGARNLGEALRRIDEGAAMIRTKGEAGTGDVNQAVHHQRNIKSAIRKLEGMDYEERDMWARDHEAPRELVHETAEMGRLPVVNFAAGGIATPADAALMMHHGCDGIFVGSGIFGAENPEAMGRAVVDAVNNHDDPERLAEIASNIGEGMQGDPNADLPEDERMQDRGN

SEQ ID NO: 6116 - protein, 387 aa, Zea mays
MADQANQPTVLHKLGGQFHLSSSFSEGVRARNICPSFSSYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6117 - protein, 535 aa, Oryza sativa
  unsure (1)..(535): unsure at all Xaa locations
MGGGGGEQQQLEVLHALNVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVATNAKQAAADMSKVLQVVEMRNIGNNGGSRRXPFGLFSGEFVRRHGLHLVGTSATWLLLDIAFYSQNLFQKDIFSAVGWIPKAATMSALEELFRIARAQTLIALCGTVPGYWFTVALIEVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 6118 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTGHGSVGSDRDAPKPLDIVSNEIILSSLRKSRKVAVMASEENDAPTWISDDGPYVVVTDPLDGSRNIDASIPTGTIFGIYKRLEELDNLPTEEKAMLNSLQSGSKLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 6119 - protein, 429 aa, Mycobacterium tuberculosis H37Rv
MDNDGTIVDVTTHQLPWHTASHQRQRAFAQSAKLQDVLYEIRGPVHQHAARLEAEGHRILKLNIGNPAPFGFEAPDVIMRDIIQALPYAQGYSDSQGILSARRAVVTRYELVPGFPRFDVDDVYLGNGVSELITMTLQALLDNGDQVLIPSPDYPLWTASTSLAGGTPVHYLCDETQGWQPDIADLESKITERTKALVVINPNNPTGAVYSCEILTQMVDLARKHQLLLLADEIYDKILYDDAKHISLASIAPDMLCLTFNGLSKAYRVAGYRAGWLAITGPKEHASSFIEGIGLLANMRLCPNVPAQHAIQVALGGHQSIEDLVLPGGRLLEQRDIAWTKLNEIPGVSCVKPAGALYAFPRLDPEVYDIDDDEQLVLDLLLSEKILVTQGTGFNWPAPDHLRLVTLPWSRDLAAAIERLGNFLVSYRQ

SEQ ID NO: 6120 - protein, 259 aa, Euphorbia esula
MDSSKDRETFVYLAKLAEQAERYDEMVESMKKVANLDVELTVEERNLLSVGYKNVVGSRRASWRILSSIEQKEESKGNEINAKRIKEYRNKVESELSTICSDIMTVIDEHLIPSCNAGESTVFYYKMKGDYYRYLAEFKAGNDKKEAADQSLKAYQTASTTAETDLPPTHPIRLGLALNFSVFYYEIMNSPERACHLAKQAFDEAISELDTLSEESYKDSTLIMQLLRDNLTLWTSDIPEDGDQKMETSGKASGGEDAE

SEQ ID NO: 6121 - protein, 97 aa, Oryza sativa
YAGVNLVFRGLPLSHSVHAEQFLVVNAAAVGELELRAVAVFHMPCGHCRQFLQEIRGAGGILIIVTFDAEDGCAPEWRTVVFLLPRPFGPHDLLLKH

SEQ ID NO: 6122 - protein, 509 aa, Triticum aestivum
  unsure (1)..(509): unsure at all Xaa locations
MGKAAAVGTAVVVCAAVGTAVVLGRRRRRRDAELLGAAEAERKRRVAAVIEDVERTLATPTALLRGISDALVLEMERGLRGDIHSQLKMLISYVDQLPTGXDEHGLFYALDLGGTNFRVLRXRVAKQQYXGEVSIPPHLMVGTSLELFDFIAAVLAKFVESGGDEFHLPMARPTALGGACACPXFPFSFPVNQLSISSGTLIKWTKGFSINGAVGEDVVAELSKAMERQGLDMKVSALVNDTVGTLAGGRYMDNDVVAAIILGTGTNAAYVEHANAIPKWTGLLPKSGNMVINTEWGSFKSDKLPLSEYDKALDFESLNPGEQIYEKLISGMYLGEIVRRILLKLAHDAALFGDVVPAKLELPFVLRTPDMSAMHHDASHDLKILGSKLKDIVGVADTSLEVRYITRHICDIVAERGARLAAAGIYGILKKLGRDKVPRDGSPMPRTVVALDGGLYEHYKKFSSCLEATLSDLLGDEASSSLVAKLANDGSGIGAALLAASHSQYADIY

SEQ ID NO: 6123 - protein, 463 aa, Streptomyces avermitilis MA-4680
MVNHATGAPALARSLTLRAVTLFGLAYMTPLIVLGTFGVVAADTGGAVPTAYLLALVAMLFTAHSYGKMAAAYPVAGSAYTYVRKAIDGRLGFLVGWVTLLDYFFLPMVIWLIGGAYLQAQFPAVPSWIWIIGFIAVTTVLNIRGIKTAERVNDLLMVFQVLVIGIFVVLSLRHVLHIGGAGALASGAPFANGATTAAGISAGAAIAAYSFLGFDAVTTLTEETVDPKRTMPRAILLTALIGGGIFVLVAYTTQLAHPGSSFDDPSSAAFEIAKSIGGDLFSSVFLAGLVVAQFASGIAAQASTSRLLYAMGRDGALPRKVFARLHERYRTPALNIVLTGAVGLIALRLDVATSTSFINFGAFVAFTFVNVSVLAMYIRRRRAGDTLNPLSYVVAPAIGAVVDLYLLYNLDGRALTLGLIWLGLGVVYLAYLTRMFRVPPPEMSFTPADSDEAQVAGALQNTK

SEQ ID NO: 6124 - protein, 370 aa, Brucella melitensis 16M
MASRKLLLLPGDGIGPEAMAEVRKVIAFLNSDLNLGFETEEGLVGGCAYDAHGQAISDADMEKALAADAVLFGAVGGPKWDSVPYEVRPEGGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQGVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 6125 - protein, 393 aa, Photobacterium profundum
MRDMQVNLDTIIFELCAIVISTAILGTVFLYARQPIILAYIAAGMLIGPHGLEWIHNAENVSQIGHLGVILLLFLLGLNLQPRKLIRLFKESAMVTLGTCSFFFLCTLGFGLAIQLALHDALVAAAALMFSSTVIGLKLLPTTTLHHKRMGEIMTSILLVQDILAITVILFLNVDSNDGMILAFGMLLLKFSLMCICAYLGVRYVVLPLFSRFDVIQEYSFVTTLAWCLLWAEAGHQIGLSYESGAFIAGLSIAVSRVSQAISIHLKPLREFFLILFFFSIGARMNLTTANIYTLWGCLFGGILILVKAWGFRFALLVAKENPSMNKELGARLSQASEFSLLLAYSAMTAELVSQEGMMFIQAATLSTFVISTYWVVKYYPTPISMVKNLRQD

SEQ ID NO: 6126 - protein, 497 aa, Nicotiana tabacum
MKKATVGAAVVGAATVCAVAAFIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEDAGIFGDEVPPKLKSPFVLRTPDMSAMHHDISSDLRVVGDKLKDILEISNTSLKTRRLVVELCNIVATRGARLAAAGILGILKKMGRDTPRQGGPEKTVVAMDGGLYEHYTEYRTCLENTLKELLGDELATSIVFEHSNDGSGIGAALLAASNSMYLEDKS

SEQ ID NO: 6127 - protein, 441 aa, Cryptococcus neoformans var. neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 6128 - protein, 219 aa, Tropheryma whipplei str. Twist
MEIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRF

SEQ ID NO: 6129 - protein, 360 aa, Schedonorus arundinaceus
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 6130 - protein, 232 aa, Antirrhinum majus
MGRSPCCEKAHTNKGAWTKEEDDRLVAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDGTASQDQVTTISFSNANSKEEDTKHKVAVDIMIKEENSPVQERCPDLNLDLKISPPCQQQINYHQENLKTGGRNGSSTLCFVCRLGIQNSKDCSCSDGVGN

SEQ ID NO: 6131 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARPALQGADVVLISAGVARKPGMDRSDLFNVNAGIVKNLVQQIAEVCPKACIGIITNPVNTTVXIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRALQGEKGVVECAYVEGDGQYAR

SEQ ID NO: 6132 - protein, 510 aa, Glycine max; identical to SEQ ID NO: 4180

SEQ ID NO: 6133 - protein, 823 aa, ASPERGILLUS NIDULANS FGSC A4
MAPLLGDWAASKARRDKEAGQGVRQKSILYVDAYDSFSYNVAAMIEEILGARVTVMMIDAEWPDGNMLECLQHYDAVVLGPGPGDPNVPEDVGIMADIWNIDSSHMLPVLGICLGFQSLCLHYGTPIGRLPEPLHGQVHRITTAERDIFENLQNLEVTLYHSLYAMLDGQAESGSCDGAASPTPALDVLAWLSIQADDLCSSVTQIPMAVRHTEKPFWGVQFHPESCKSDREACSQLLRKWWDMAIKYNKSRHRDGCGSLSIDMIRSSCEDTRLPNVAFTMVNWSVSSSANCASRLFDTCQLDAEGLCELFNDPGVPTVLFQSNGRYSIISVPSPGSWRLEYYSQRHSLSMQRQSVSSSGCNALKDSDMRLEATMSVSQFWDVLRYLMDMKKVESGNYELPFWGGFLGYFSYELGLACLAHPKHESGSIADDHCSQESASADDPPDVSLLWTDRSVVVDNETGRVILQSTREADNLPAGWLDQASKTLERFCCMDILPKPKNSASDDEFLDSVLGRGVIQFPSENAYRNQVEACKDELRAGESYELCLTCETSITLPSPDVPIGRIEFPWKLYKRLRMYNPAAFSAFARLGNSKIVSSSPECFLNWDRHSTLEMKPMKGTVRKSDSMTMERAREILGSTKEMAENLMIADLVRHDLYGICGAGNVHVEKLLKVEDHGRVYQMITHVKGHVDPHRPGYAAKSLPRLQSSNMSGYGLTALQRCLPPGSMTGAPKERSCMHLSSIEGRKRGIYSGVMGFLDLGGGGSFSVLIRTAFTSSNDNDDVQKWRIGAGGAVTMLSSADGEWAEMLTKLQTVCGIFMPSHAK

SEQ ID NO: 6134 - protein, 242 aa, Daucus carota subsp. sativus
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 6135 - protein, 240 aa, Arabidopsis thaliana
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 6136 - protein, 427 aa, Lemanea fluviatilis
IEASAAIAGESSTATWTVVWTDLLTACDLYRAKAYKVDAVPNTSDQYFAYIAYDIDLFEEGSISNLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEDMYERAEFAKQLGSIICMIDLVIGYAAIQSMAIWARKTDMILHLHRAGNSTYSRQKSHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDFVAEGPQILRDAAKTCGPLQTALDLWKDISFNYTSTDTADFV

SEQ ID NO: 6137 - protein, 239 aa, Asparagus officinalis
MGRGRVELKRIENKINRQVTFAKRRNGLLKKAYELSVLCDAEVALIIFSNRGKLYEFCSSSSMLKTLERYQKCSYGAPDTSVQIRESQMLQSSHQEYLRLKARVEALQRSQRNLLGEDLGPLSSKELEQLERQLDSSLKQIRSTRTQYMLDQLADLQRREQMLCEANRSLRKRLEESSQANQQQVWEDANAMGYNRQPNQPHGDQFFHPLECQPTLQIGFQPDQMPGPSVSNYMPGWLA

SEQ ID NO: 6138 - protein, 485 aa, Rhodymenia pseudopalmata
NSVERTRIKNDRYESGVIPYAKMGYWDPDYVVKDTDILALFRVTPQPGVDPIEASAAVAGESSTATWTVVWTDLLTACDLYRAKAYKVDSVPNSSEQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMENMYERAEFAKQLGTVIIMIDLVIGYTAIQTMGIWARKNDMILHLHRAGNSTYSRQKNHGMNFRVICKWMRMAGVDHIHAGTVVGKLEGDPLMIRGFYNTLLFTHLDVNLPQGIFFEQDWASLRKVTPVASGGIHCGQMHQLLDYLGDDVVLQFGGGTIGHPDGIQAGATANRVALESMVMARNEGRDYVAEGPQILQNAAKTCGPLQTALDLWKDITFNYTSTDTADFVETPTANV

SEQ ID NO: 6139 - protein, 835 aa, Geobacter metallireducens
MIQKKRGKTVHIPGLTDLPPLPRDVPSLMEDFRHYYTYNLGRDKFCRSVHYHYKALALAVRDRLMEDWKNTRYAYLDADCKRGYYLSLEFLMGRALGNAMLNLGVTDTAAKALMDLGIAMEDLAEAEVDAGLGNGGLGRLAACFLDSCATLQLPVMGYGIRYEYGMFRQRIVNGHQVEEPDHWLRNGNPWEIERQEYTQRVCYGGRTERYGTGDGGFRVRWVDTHDVLAIPYDTPVPGYSNGTVNTLRLWKSVATDAFNLVEFNAGSYTESVAAKNEAENITMVLYPNDASESGKALRLRQQYFLASASLQDVIERWVVISKGDFSGFAEKNCFQLNDTHPSCAVPELMRLLMDEQGMGWDEAWGITTRTMAYTNHTLLPEALEKWPLSLFAQLLPRLLEIILEINARFLAEVASRWPGDHERLRRMSLIEEGPVPQVRMAYLAIVGSFSVNGVAALHSQLLAQGLFRDFHELWPHKFNNKTNGVTPRRWLAWCNPGLSRLITETIGDGWVSDLSRIGKIAAFADDPGFREKWREVKRANKERLAAMVLDKCCVAFDPEALFDVQVKRIHEYKRQLLNILHVIHLYDRIKRGDTEGWTNRCVLIGGKAAPGYFMAKLIIKLTSNVAQVVNADPQVGDRLKVAFLPNYRVTAMEVVCPGTDLSEQISTAGKEASGTGNMKFMMNGALTIGTLDGANIEIREEVGDANFFMFGLTAEEVEAARRGYDPGAIIEADADLGRVMNLLAFGHFNLFEPGIFDPIIGAITSPHDPWMVAADFRSYVNAQQRVAAAYRDREQWARMSIINSASSGKFSTDRTIREYNDGIWGLQPVPVLAAR

SEQ ID NO: 6140 - protein, 235 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 6141 - protein, 289 aa, Triticum aestivum
MDLLDAGHRHSSELPAAGADMEGASVLPLSGAAYQPYVSELLSFSIERLHKEPELLRVDGERVRRQMQEVAVENYAAFIAASEALSFVRAQLEGFDKHLEALVEEIPNLTSGCTEFVESAHQILEERKLNQTLLANHSTLLDLLEIPQLMDTCIRNGNYDEALDLEASVSKISKLHPDLPVIQGLAAEVKKTIQSLISQLLQKLRSNIQLPECLRIVAHLRRIGVFSESELRLQFLRCREAWLSGILDDLDQRNVYDYLKGMVSCHRTHLFDVVNQYRAIFNNDKSGSE

SEQ ID NO: 6142 - protein, 1367 aa, Neurospora crassa
MASELSPRAVRFSQTDDEPIARLDKHKTVSRPNPRANDSDNSNPSTDAHDDLHVREQIDELGSLSRYVESHSGSVPSLVPGSLTSSLPLANGSSSRRGASSETYANGTPSRPQRPTAPARTPSNTYQPYNQRRPPQGQPSSYMANNPHARDGSRPRPLAGTSTFRAQEREYVRRLRQQDYNNDYFDAYGSGEQYDSDSEGETPSSEGAFDSYDDAHIMFASNEDIQITEEDLRDPESRERLEWHGMLEAVLTGDVVRQEKKRLIGSNDEAFGKSAHNVELWLGIRARLCGRHLPVQKRVVEDARAALDRSINDIINFAIAGESEAGKPPFEQVRDVVNKIERIESLYPSSRELMTALKPGVYSAYQETCDAVISWYNVNEMINTELSILKKWVGNDALDFSRTKEKSPSGNGLSDESSFLDRLMKEEGLKSLHEDKGSEPKSLKKKSRLDGISRVITKAKDTLIQNAEGFQKRHLPPYIEELLTLISFPSRLIEEIIKMRLAYAKKMKDSAQQNPMMQDQMISQFQVLLKLAIKIKREYMEIARPEPGWDLPPCIDEDFDRVILEALKYYFKLLNWKLSGNKNTFKEAELLFQEWGFGNEIGRYLAHGDVEVAEQFSSLTYKAWNRLSQTFEKEVQRRPKESVPEMTKRYKQILDSVRVRQRMLQRFSRMLNDNYENACDYTIAFEQPQMLHQLYDRLIETGHFQVYSASPEHKDILIIASPTLHNRDDEIQVLMGTFTYEAAIEDPSDPYLLIIKAEDPPQWLGPVHTLRVRNEPLDIKLGHMRLIAGGCQPRLLNARKAFVDRIDMQVDPVVEQRSNLQKVNFRLMEIRKVAFKLSNAFMDSVEAIRRQTRGLNCQELIQTCFIFATEFGQRSLLYMDNNRRTMNNLKLTKLALDWVSFICDDCISSDRKTFRWAVQALEFAMGMTRGRHILGLGEDEYARLRAKVAGCMALLISHFDIMGARSSVAAQAEKKRLEGLVNQIKRLNKGQMLDDNEAAKYYQEHRLEELAKVDNYRKEILLQQSAMGRVLEASNEVDRSLAWLSSTATNFTMRWQQGHFVGGGTFGNVYAAVNLDTGQLMAVKEIRLQDPKLIPTIAGQIRDEMRVLETVDHPNVVSYYGIEVHRDRVYMFMEFCSGGSLANLLEHGRIEDEQVIMVYALQLLEGLAYLHELKIAHRDIKPENILLDHNGIIKYVDFGAAKLIARQGRTLVQDVASTKPNKSMTGTPMYMSPEVIKGENAGHFGAVDIWSLGCVILEMATGRRPWANLDNEWAIMYNIAQGNPPQLPSQDQLSPEGIDFLRRCFMRDSTKRATAMELLQHEWIMTIRNRVVEPATPSSDAGSSTTSQGALNPGNSSRGGFPGDGMY

SEQ ID NO: 6143 - protein, 181 aa, Zea mays
MASSMFSSTAVVTSAAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 6144 - protein, 417 aa, Zea mays
  unsure (1)..(417): unsure at all Xaa locations
MDPYKHRPTSGANAGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHXATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGC

SEQ ID NO: 6145 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEKNALEGMLDTL

SEQ ID NO: 6146 - protein, 759 aa, Streptomyces coelicolor A3(2)
MSEANPLKRVARKVTEGLHGEAGGPPDGIPGRPGPESPSAAEPTEPREPLPPKPDQTGPDTVSPTGQPTGADQARVAQSGSYLTNAQGTRLYDTDHSLKAGPRGPVLLQDHHLREKVMHFDHERIPERVVHARGAGAHGVFQSYGTAASVTKAGFLAADVETPVFTRFSTVVGSRGSSDTVRDTRGFATKFYTSEGVFDLVGNNIPVFFIQDAIKFPDVVHAAKPHPDREIPQAQSAHDTFWDFVSLHTEATNHTIFFMGDRGIPRSFRMMEGFGVHTFRLVNAEGATTLVKFHWKPKLGVHSLVWDEAQLINGVDPDFHRRDLADAIEAGAYPQWELGIQTFPDNPEQTFEGIDLLDPTNFVPEELAPVQPVGLLTLNRNPSNFFAETEQVAFHVGHLVPGIDVTDDPLLAGRLFSYLDTQITRLGGPNFPQLPINRPQAPVNDMLRDGMHQSAVHRGVAPYRPNSLDGGCPFTAGADTSAFVEAPVRVPEGRKVREASESFADHFSQPRRFWLSMSPVEREHIIGAYTFELGKCYEQAIRERTLQVLANIDPELCAGVAEGLGLPAPEPTVPLAEVEPSPALSQVGGVWPLDGRVVGIVTGGADLEGVGAVREAVLNAGMVPLVVAPTGGTLGSGDAALTVQRSYVTARSVEFDAVLIAGTPDMGGDAYTPRDYKAGPAPAGPGTVDPRVSLLLSEAFRHGKAIGVWAGGTPALEASGVPADAPGVIVADSGTAALERVTELMGSHRVWERFTTPRG

SEQ ID NO: 6147 - protein, 465 aa, Staphylococcus xylosus
NSMTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGI

SEQ ID NO: 6148 - protein, 542 aa, Candida albicans
MKLSKSTLIATLALTATSTNALVVQNPFSNIQQALKLDLSYDKLTSKLTDTFEQGKANIISTIAKVMNEPLDGLTPEIKNIWSEMLMKFPNSITELNFKAPPKKGKITTQQFDFHVTDAQVPNHKLRIKSTPKDLGIDTVKQYSGYLDVVDEDKHFFYYFFESRNDPKNDPVILWLNGGPGCSSLTGLFFELGPSSIDKNLKPVYNPHSWNANASVIFLDQPINVGYSYSSQSVSNTIAAGKDVYAFLQLFFKNFPEYANLDFHIAGESYAGHYIPAFASEILTHPERNFNLTSVLIGNGLTDPLVQYEYYEPMACGEGGEPSVLEPEECDGMLNSLPRCLSLIESCYESGSVWSCVPATIYCNNGQMGPYQKTGRNVYDIRTMCEGSSLCYSQLEYIDQYLNLPEVKKALGAEVDEYQSCNFDINRNFMFAGDWMKPYQKNVIDLLEKELPVLIYAGDKDFICNWLGNQAWTNRLEWSGSKGFTKAPVKSWKVGKNAAGEVKNYKHFTFLRVFGGGHMVPYDQPENALDMVNRWISGDYKY

SEQ ID NO: 6149 - protein, 73 aa, Triticum aestivum
  unsure (1)..(73): unsure at all Xaa locations
DHASADACFDPRFRARFLRTYVPLLVSISFNTHHDTLNIVEKYANSNIQIHTFNHSQDPCXWPSMGRTVKDGW

SEQ ID NO: 6150 - protein, 523 aa, Candida maltosa
MAIEQIIEEVLPYLTKWYTILFGAAFTYFLSIALRNKYYEYKLKCENPPYFKTAGFVGIPGLIDVIKAKNAGKLADYADQTFDEYPHHSFYMTVAGMLKIVLTVDPENIKAVLATQFNDFALGARHAHFDPLLGDGIFTLDGEGWKHSRAMLRPQFAREQIAHVKALEPHVQVLAKQIKLNKGETFDLQELFFRFTVDTATEFLFGESVHSLYDEKLGVPPPNNIPGRENFAKAFNTSQHYLATRTYSQMFYFLTNPKEFRDCNAKVHKLAQYFVNKALDASEDEVAEKSKGGYVFLYELVKQTRDPKVLQDQLLNIMVAGRDTTAGLLSFAMFELARNPKIWNKLREEIEVNFGLGEEARVDEISFETLKKCEYLKAVLNETLRMYPSVPVNFRTATRDTTLPRGGGKDGTSPIFVPKGSSVVYTVYKTHRLEEYYGKDAYEFRPERWFEPSTRKLGWAYVPFNGGPRICLGQQFALTEASYVITRLAQMFEHLESKDETYPPNKCIHLTMNHNEGVFISAK

SEQ ID NO: 6151 - protein, 326 aa, Enterococcus faecalis V583
MLFLKKEDIIKNFSMREAIDADKKALSLYSAGKAIVPLRTNIDVPKSNGQSLYMPAYVEGGEGALGVKIVSVYPKNIKKNLPSVPATMIVLDPETGMVSACLDGTYLTQLRTGAVQGAATELLAKKDAKIGALIGTGGQAQSQLEAMLTVRKLEEVRIFDIDFERANQFAEEMMQQFSVTMRPTKTSQECVEGADIITSVTTSKRATFSAEWVKKGAHINGVGAYTPEMCEIPREIIKAADVVIFDTMDGVLKEAGDFISPLQDGYIQRDSYHGELGQLINEELVGRTSGEQITIFKTVGSAVLDVVVATEIVKKAKENNLGKLIY

SEQ ID NO: 6152 - protein, 490 aa, Burkholderia fungorum
MNVTPSSRLLGDDVWHGRIFTGSWCNGASEAEVKEPASGKRLARIGMADGALVAASAKTAFEAQQEWAALPYDERAAVLRRAARLAEESVEEIVGWIVRESGSTRAKAAFETQVTVKALHEASALPSRSAGEVLPSGPGRLSLARRRPLGVVGVISPFNFPLYLAMRAVAPALSLGNAVVLKPDPRTAVCGGFVIARLFEMAGLPNGVLHVLPGDGAAGAGLTSDPHVAMIQFTGSTNAGRKVGEAAGRHLKKVSLELGGKNSLIVLDDADLDRAVANTAWGAYLHQGQICMATGRVLVQRAIYERFVEKLVAKASSLTVGDPATDDVALGPLINGTQRDHVTRVLDAAQQAGARVEAGGSFRDLFFEPTVLTGVTKENPAFSEEIFGPVAVVVPFDTDEEAIALANDTEYGLAIAIVTSNVGRALRMGERLRSGLLHINDQTVNDEVINPFGGVGASGNGTSVGGPANWEEFTQWQWLTVKGEAPLYPL

SEQ ID NO: 6153 - protein, 246 aa, Oryza sativa
MATARVSLILLVVVLAASACAEGLRLPRDAKFPAAQAERLIRSLNLLPKEAGPTGAGDVPSVAPGELLERRVTLPGLPQGVGDLGHHAGYYRLPNTHDARMFYFLFESRGKKEDPVVIWLTGGPGCSSELAVFYENGPFTISNNMSLAWNKFGWDTVFFKKHPEFAKNDFFITGESYAGHYIPAFASRVHQGNKANEGIHINLKGFAIGNGLTDPAIQYKAYTDYALDMNLIKKSDYDRINKFIPP

SEQ ID NO: 6154 - protein, 151 aa, Zea mays
CRQERFITRWVDALSDPRLTHEIRTIWLSNWSQADRSLGQKLASRLSAKPSITLPKQQQKQHRHCIHGYHSELLSYDGKTENWVDELSVPHSAHVHLVAMTDELGQQKEQVGPQGCMELSSDTSDTANKLIFAVVTQHALRPIPPQHSTDQ

SEQ ID NO: 6155 - protein, 923 aa, Vicia hirsuta
MELQALWITRLAVACVLCLCIFIRSGSSATGGFESIACCADSNYTDPKTNLNYTTDYKWFSDKSSCRQIPEILLSHRSNVNFRLFDIDEGKRCYSLPTIKDQVYLIRGTFPFDSVNSSFYVSIGATELGEVTSSRLEDLEIEGVFKATKDSVDFCLLKEDVNPFISQLELRPLPEEYLRDFSTDVLKLISRNNLCGIEDDIRFPVDQNDRIWKATSTPSYALPLSLNVSNVDLKGKVTPPLQVLQTALTHPERLEFVHDGLETDDYEYSVLLYFLELNNTLTAGQRVFDIYLNSEIKKENFDVLEGGSKYSYTALNITANGSLNMTLVKASGSKFGPLLNAYEILQARPWIDETSQPDVEVIQKMRKELLLQNQDNEALESWSGDPCMIFPWKGVACDGSNGSSVITKLDLSFNDLKGTIPSSVTEMTNLQILNLSHNHFDGYIPSFPSSSLLISVDLSYNDLTGQLPESIISLPHLKSLYFGCNQHMSDDDEAKLNSSLIITDYGRCKAKKNKFGQVFVIGAITSGSILITLAVGILCFCRYRHRTITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRVLPSTTTMAESTITTQNVSHPQPR

SEQ ID NO: 6156 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 6157 - protein, 322 aa, Staphylococcus aureus subsp. aureus Mu50
MKHLLVIHTGGTISMSQDQSNKVVTNDINPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGSNGPKARLKLLVALSNNLDKAEIKSYFEL

SEQ ID NO: 6158 - protein, 151 aa, Glycine max
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSFDPVVRAWSHRASMLVPPF

SEQ ID NO: 6159 - protein, 696 aa, Penicillium janthinellum
TASGKLQRKFLDRFAISMGRGVALGKTYGTLGAASRGATLLQDLLFTEIIFAFDRERVPERAVHARGTGAHGTFLSYEDWSNLTAASFLSAEGKFTPEMTRFSTVSGARGSADTARDVHGFATRFYVDEGNFDIVGNNIPVFFIWDVIIEPTLMALHAQKPNPRFHLPRGQQDPNRISDNLTARGDSLAQGSQISSERGSPKAYSNTEPNKHRSFRLVTDNGKQFQCSNHWQPLQGFIDLGVEEAWRFPEEGEGYVAENLFESIELLTVGDEELEIQSMSFNNDLRERFNSSEVTKSSVVRLVPLITQGKLVFNKNIQMLFNEVIGAMFQPGHIVRGVDFTEDPLLQGRLFSYLDTQLNRHGPNIQQLGFNRPPRAPIHNNNRDGAGEMIDLPPFASFVETQEWGAKDIKQTAVGQNKFDQEHRFSHWKFGVNGFVHTRNDDNVTHARGFFTAPERGQQKKRVAAFDRMFTVVGLSVDGQQANSDQYADFDAAAGKKVAKAIGVEAPKPNSNYFHPTDVFGEHIAASGTKYGVPEGNTKGVLLASVNKPASIAQGAKLQVVASSGDFAEFFISAKQLNMREVTQGIIPLVPVLKLAKLDLGKTFRFQLMQVGNIEELERFGFDLPDLTDKQVDLSAMGMFETTFRPTSRAAQFEQGKTKLVKGLQGKNAFMDRALKQPSNNREKIQRFADRFAVQD

SEQ ID NO: 6160 - protein, 878 aa, Arabidopsis thaliana
MLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKFDALIVETFGTRIEKLIQEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVRFFYSFTCSENLYLVMEYLNGGDFYSMLRKIGCLDEANARVYIAEVVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEVKQHSFFKDIDWNTLAQQKAAFVPDSENAFDTSYFQSRYSWNYSGERCFPTNENEDSSEGDSLCGSSGRLSNHHDEGVDIPCGPAEFETSVSENYPFDNFSFKNLSQLAYINYNLMSKGHKDETQPSLQRR

SEQ ID NO: 6161 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALATFLDTDDAWNLCA

SEQ ID NO: 6162 - protein, 543 aa, Schizosaccharomyces pombe
MPAMKRKKLDMESSRWFPKGETCFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 6163 - protein, 579 aa, Photobacterium profundum
MFIKWRDTMTVGKYLRWKDEAGNDFRPVALTGTELLNDRNLNKSTAFSYEEREAFQLVGLLPPKVQTFDDQLNRVYDGFRNASTDIEKYLFLRALQDRNETLFYALLSRHVEEMTPIIYTPTVGKACQEFSHRYQKARGLYITEDSVDQMGDMARHFTGKDIKIIVVTDSQGILGLGDQGVGGMGIPIGKLSLYTLGAGIHPAHCLPIALDVGTDNQDLLDDPMYLGMPRKRMRGEEYKIFIRKFVKQIQQHFPKAVLQWEDFSKSNAFDNLSDYEDDLPSFNDDIQGTGAVVLAGILGAVKIKEEKLADQTYVVYGAGAGGVGVADQIYAGLLKEGCSHSAAREKIFVLDSQGLVFDDREGLDEYKKRYAKPRELANNWQTKELGKVSLTELIDNHRVTVLLGTSGIGGAFKAEHVQKMMEYTKRPMVFPLSNPTANCEALPEDVYQWSDGQVIVATGSPFSDVNYNGREYRIGQGNNVFIFPGVGLASIVSGTPKITLDMFTMASYALADCISDDDLAAGCVFPRISKLKEVSMVVATRILENMQTTEPNSPLRGKNIQQELAMHMWEPAYLPYRRV

SEQ ID NO: 6164 - protein, 424 aa, Oryza sativa (japonica cultivar-group)
MEGAAPLLAARGEEEVVEGRRRGGGGGATSAQTLGNVVVSIVGTGVLGLPYAFRTAGWVAGSLGVAAAGCATLYCMLLLVDCRDKLEEKESEETYHGHYTYGDLGEKCFGTIGRCLTEILILVSQAGGSVAYLIFIGQNLHSVFSQLMSPAAFIFAILLPMQIALSFIRSLSSLSPFSIFADVCNVLAMAIVIKEDLQLFDHPFANRSAFNGLWAIPFTFGVAVFCFEGFSMTLALESSMAERRKFRWVLSQAVVGIIIVYACFGVCGYLAYGEATKDIITLNLPNSWSSAAVKVGLCIALVFTFPVMMHPIHEIVEERFQSSGCFPKLSHKVRGAEWVGLHSSRIVMVTILSVVASFIPAFGSFISFVGSTVCALLSFVLPTIFHLSIVGSSMSPWRRWGDYGFLLFGLGFAGYGLIRALFSH

SEQ ID NO: 6165 - protein, 122 aa, Methanosarcina acetivorans C2A
MIAMSNMDDELEEIRKRRLAEIQRQQAQQQPSDVQAAYQQEQARAEMEAQKQAILRQILTPEARERLTTLKMSRPALGEQLEMQLISLAQSGRLKAQIDDEQLKTLLMRMQPKKRKTSITRV

SEQ ID NO: 6166 - protein, 214 aa, Triticum aestivum
  unsure (1)..(214): unsure at all Xaa locations
MAPTVMAXXXTSVXPFQGLKXTAXLPVSRRSNGASXXSXSNXGRIRCMQVWXXEGIKKFETLSYLXPXNTEALLKQXDYLIXXKWVPCLEXSKVGFIFREHNASPGYYYGRYWTMWKLPMFXCTDATQVINEVEXXKKEXPDAYVRIIGFDNMRQVXXVSLIXFKPXGCEERGLKQNSPGQHIKVFAGFFDFWGCFLSHLFLVPKKNIGKGPFG

SEQ ID NO: 6167 - protein, 503 aa, Azotobacter vinelandii
MPRAAPTPCASCAWATSSIERRGLRCNRANLRTGRATSTSAPRMPNNRSCSPRARPFQPLHRTRHTMSNPSTSIQHVAAREILDSRGNPTVEAVVTLAGGATGVASVPSGASTGSREALELRDGALRYQGKGVMKAVDNVNGAIRERVVGLDALDQRAVDQAMLERDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKAFDSRGFADYLAGLCERYPIVSIEDGLDESDWAGWAYLTEKLGDKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCSR

SEQ ID NO: 6168 - protein, 477 aa, Hymenena falklandica
KNERYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKYGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDVNLPLGIFFTQDWASLRKVTPVASGGIHCGQMHQLLDYLGDDVVLQFGGGTIGHPDGIQAGATANRVALESMVIARNEGIDYVTEGPAILRDAAKTCGPLQTALDLWKDITFNYTSTDTPDFVETPTANV

SEQ ID NO: 6169 - protein, 102 aa, Glycine max
  unsure (1)..(102): unsure at all Xaa locations
DNTTIARNGGRVHCMQVRPPFGKKKLDTLSYLPDLDDAHLTXEVEFFLKKGWTTCLEXELEHSIQYLEHNRTPAYXYGRFWTMLNLPMYDCTDASEVLEDLQ

SEQ ID NO: 6170 - protein, 347 aa, Arabidopsis thaliana
MGCSFSGLNALYDAVNGGGDVWINENRFRIVRQLGEGGFAFVFLVKEIVADASSAASGGGLAKKVKDPAHLSADGTYAMKKVLIQNKEQLELVREEIRVSSLFNHPNLLPLLDHAIISVKDGQEGAWKHEAFLLFPVHLDGTLLDNFTLMKAKKETFSTTDVLHIFRQLCDGLKHMHSLEPPYAHDDVKPGNVLLTRRKGQPPLAILMDFGSARPSRKQIRSRQEALQLQEWTSEHCSAPFRAPELWDCPSHADIDERTDIWSLGCTLYAIMYGVSPFEYALGESGGSLQLAIVNAQIKWPNTGPKASYPEALHQFVTWMLQPQAAVRPRIDDIIIHVDKLIAKFTK

SEQ ID NO: 6171 - protein, 389 aa, Methanosarcina mazei Goe1
MTFPMYSDRINALPPYLFAAIDEARDELIAKGVDVIDLGVGDPDLPTHPHIVEAMQKAVCDPGTHQYPSYAGMPEFRKAAAEWCRKYKGIEIDPATEVLSLIGSKEAVAHIPLAFVNPGDVVLYTEPGYPVYKIGTLFAGGEPYPLPLKAENSFLPDLDSIPEDVLKKSRLFFFNYPNNPTAATADMAFFEKVVKFCKKHDIIAVHDNAYCQMAYDGYEAPSFLAAEGAMDIGMELYSHSKTYNMTGWRLGFAVGNKDLIKGLGKVKSNVDSGVFDAIQIAGIAALSSPQDCVNETNKIYEERRNALIEGLTAMGLEVKPPKATFYIWAPVPKGFTSISFAKLLLEEAGIVATPGVGFGDAGEGYIRFALTKPVERIKEAVERMKKLQL

SEQ ID NO: 6172 - protein, 320 aa, Sinorhizobium meliloti
MDRVRTVRKAVIPVAGNGTRFLPATKAVPKEMLTIVDRPVVQYAVDEARQAGIEHIVFVTSRNKQVIEDHFDDAPELISSLSRSGKSAQISELEAMLPAAGSVSFTRQQAPLGLGHAVWCARDLIGDEPFALLLPDMVSFGARGCVAGLMDLYHEVGGNVVGVEQCAPEEASKYGIVGKGETVRHGFSVTEMVEKPAAGKAPSNYYLNGRYILQPEIFSILAHQTRGAGNEIQLTDGMLTLSQSQSFHAHPYEGRTFDCGSKQGFIEANVAFALLVRTSAISFSNPSATWFCLTKAASGRHKRRLPAVLRDCRNKDRRRR

SEQ ID NO: 6173 - protein, 187 aa, Magnetococcus sp. MC-1
MLLMIDNYDSFTFNVVQYFGELGAEVVVHRNDKITVSQIEALNPSRICISPGPCTPSQAGVSLETILCFADRVPILGICLGHQAMGQAFGGKVIRAPYVMHGKTSQVLHDNRGVFKGLANPLTTTRYHSLIVERESLPECLEISAETEDGLIMGLRHKTLPIEGVQFHPESILTQQGHDLLRNFLEM

SEQ ID NO: 6174 - protein, 412 aa, Thermoproteus tenax
MDTTIEELLARRILTGRGDQTIEVEVYTADGFGKAAAPAGASKGKHEVAFLPEGGIDAALSAFERLVSPELAGVDAAEQYAVDGKLEEVDGTGRFERIGGAVAIAVSMAAARAAANTLGIPLFRHLGGAPARTLPLPLGNAIGGGKHSRGLGPDLQEFLVIPLNPPDIATAVLANLEVHKRALKYIVKADPHFTGGKNDEGAWTPRISAETALKILKESAAEVSKEIGVEIGLGVDAAASSLWNGSKYVYQNEGKERGPREQLEYMARLLDEFGLVYLEDPFHEDDFQSFAELTSRFKDRLIVGDDLYVTNAARIERGGREGATTAALIKPDQTGTLTRAHEAVKTARRYGMRIVVSHRSGDTEYDTLAHIAVAFGAEVIKTGIVGGERTAKLNELIRIGDYLGKWGRISSL

SEQ ID NO: 6175 - protein, 119 aa, Methanosarcina barkeri
MSTMDDELNEIRKRRLAEIQRQQAQNQQSDIQAAYQQEQAKAEMEAQKQAILRQILTPEARERLTTLKMSRPAIGEQLEMQLISLAQSGRLPSQISDEQLKTLLMKMQPKKRKTSITRV

SEQ ID NO: 6176 - protein, 338 aa, Streptococcus agalactiae 2603V/R
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 6177 - protein, 64 aa, Trichodesmium erythraeum IMS101
MILPGVAVKVKNLGDTYYGFQGQVQRVSDGKAAVLFEGGNWDKLVTFKLSELEVVDATAGRKKK

SEQ ID NO: 6178 - protein, 246 aa, Zea mays
  unsure (1)..(246): unsure at all Xaa locations
MGRQFFVGGNFKMNGSIKSITDIVENLNKGKLDPNTEVVIAPPALYLLLTREHLRKGLEVAAQNIFDKPNGAFTGEISAEQLKDSGITWTLVGHSERRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEXARILYGGRVSEKTATSLPXEANIDGFLVGGASLKPAFVDIITLT

SEQ ID NO: 6179 - protein, 340 aa, Pinus sylvestris
MGSTGKIKIGINGFGRIGRLVARVALTRDDIELVGVNDPFISTDYMSYMFKYDSVHGKWKHHEVNVKDSKTLLFGEKSVAVFGCRNPEEIPWGEVGAEYVVESTGVFTDKEKASAHLKAGAKKVVISAPSKDAPMFVVGVNEHQYKSDVNIVSNASCTTNCLAPLAKVINDKFGIVEGLMTTVHSITATQKTVDGPSNKDWRGGRGAGFNIIPSSTGAAKAVGKVLPALNGKLTGMAFRVPTPDVSVVDLTVRLEKSATYDEIKAAIKAESEGNLKGILGYTEDAVVSTDFIGDSRSSIFDAQAGIALSDNFVKLVSWYDNEWGYSSRVVDLIVHMAATQ

SEQ ID NO: 6180 - protein, 488 aa, Botryidium cystosum
MSKNVQERTRIKSERYESGVIPYAKMGYWDADYNVKATDVLALFRITPQPGVDPVEAAAAVAGESSTATWTVVWTDLLTACDIYRAKAYRVDPVPGTTDQFFAYIAYQCELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGINRSAAATGEVKGSYLNVTAGTMEDMYERAEYAKTIGTIIVMIDLVIGYTAIQSMGIWARKNDMILHLHRAGNSTYARQKNHGINFRVICKWMRMAGVDHIHAGTVVGKLEGDPLMVKGFYNVLLSTVNEINLPQGIFFEMEWACLRKTVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPDFVETATESK

SEQ ID NO: 6181 - protein, 93 aa, Glycine max
  unsure (1)..(93): unsure at all Xaa locations
CEDSLLAAPIILDLVLLAELSTRIQFKAENEGNSHSXFHPVATILXSYLTKAPLVPPGTPVVNALSKQRAMLENIMRACVGLAPENNMILEYK

SEQ ID NO: 6182 - protein, 432 aa, Haemophilus somnus 2336
MKKFILLGLLLSFSSSSIAELSDWIKPISDISSGDTAWVMISAILVLFMTIPGLALFYGGMVRKKNVLSTMAQSFAVSGLIAVIWLCFGYSLSFTPNNAFIGGMDRFFLQGLNVFTEQKMLTVYPGAGTIPESVFMIFQMTFAIIAGAIITGATVERMKFSALLLFVGLWSLLIYVPTAHWVWGIGGWLVNDGVLDYAGGTVIHINAGVAGLVAAIVIGKRVGYRHEVMMPHNLVLTLIGTAMLQIGWFGFNAGSALAADARAGMALATTQISASVGALTWILVEVFCKHKPSALGLASGAVAGLVGITPAAGFVSVQSALFIGMITSAVCFVGVMKLKYWFRYDDTLDAFGIHGLGGIVGAVLTGIFVSPDISATETTLWTQIESVLITIIFSASGSFVLLKIIDKTVGLRVERDEERQGLDLSCHGERIE

SEQ ID NO: 6183 - protein, 620 aa, Zea mays
MEVDRKKNLQIGSKGKEVQSKNPRREEPLASSEVDMDEPDAPESGDMIVDGNNGCSRGSPLQPMDSKNSKGCAVKPTSVSSDFGEELDLDLGGEKSETQQERKLSRQDRVELCRSFQLAVSSHDWESAEGLVGMADAQGLNDVLCVAVDAIWFLSDRDELLAIVGLIKRVVSEGAKDFTRAALRTSFLASCVSACRGRSTSLADAVSFMGQKLHERLQESQGDEVLKAEASAKVHRFTEWALKCIGLHSRVRENRGKGNHDTVIEVQLQLSAFKIFLDLADNELTGKDFTEAFDAACFPLTLFSTTFDQGWASGISAAAVQGLLELLVEGGADNVNQCFLEAARYGSTELVRILLQVAQRNSLDIDVDLALGFAAHYGKIETMGCLVEEGNAIGFLGPLMRAAERGCLQVVEWFVNHGCREMELCLALTAATSNSQIAVAAYLLPLVPQHVLAPLSIEIIKAAGERTTGSLQGVDFLLRSDFLNDPAATYAVADSIARCTDEAVDAKLRSFMNEHWSEAAFCAGFESAQQHFVNFMRIMERGESPIRLGDLPLELVIAMAYLPLYKECMNSNGRLLPQRLRGQLVEAASRLEDRQVERDSQSRELLAILEHHIPRFMMQT

SEQ ID NO: 6184 - protein, 495 aa, Alternaria alternata
MTSVKLSTPQTGEFEQPTGLFINNEFVKAVDGKTFDVINPSTEEVICSVQEATEKDVDIAVAAARKAFNGPWAKETPENRGKLLNKLADLFEKNADLIAAVEALDNGKAFSMAKNVDVPAAAGCLRYYGGWADKIEGKVVDTAPDSFNYIRKSLLVFAVRSSMELPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAATLQGPQVSQLQFDRIMGYIEEGKKSGATIETGGNRKGDKGYFIEPTIFSNVTEDMKIQQEEIFGPVCTISKFKTKADVIKIGNNTTYGLSAAVHTSNLTTAIEVANALRAGTVWVNSYNTLHWQLPFGGYKESGIGRELGEAALDNYIQTKTVSIRLGDVLFG

SEQ ID NO: 6185 - protein, 122 aa, Zea mays
MHQQQQQLAAVAPKGCVTVRVGLEGEEQRRFAVPLGHLKHPLFGALLEEAEREYGFRRQGALAIPCRVDRFVQVEHLIGQDLHGTSCAQHLVDLDGALASGGAHHHQHHHLHLPRFVGCFRA

SEQ ID NO: 6186 - protein, 212 aa, Bacillus cereus ATCC 14579
MGTNKPVVIGIAGGSGSGKTSVTKAIFDHFKGHSILILEQDYYYKDQSHLPMEERLKTNYDHPLAFDNDLLIEHLQQLLAYEQIDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDIMVTKIATILEQKVNL

SEQ ID NO: 6187 - protein, 422 aa, Oenococcus oeni MCW
MSKPDQLNLTPGLQGVVSSSLVLGAFFGALGCGRIADKFGRKQTLRWIAALFTSSTILCALSMNFLFMSFFRFALGLSVGAASSLSPMYLAEISPEPVRTINVNKNAIFIVLGQLSAFCMNAFLGNIWGNWNPIWRIMIVSASIPAIILWINSFHIVGSPHWLLLKKRFKKARKLFSKLGFEKSTFDGIEQESKTKSKKDDDISWKSILKKPSLVYLLISGILIALIQQISGVNTVMYYGTILMEKVGMGQSGSLYANILIGLVSFVASIFGTRLIARFDHHRMLLISLFGNILFLALLGLVLRLSLFTQTITNALVLIFLALFLASHQGIVSPVTWLIMSEMFPGKIKARFMSIATATTWITNFIISLIYPLLISAVGTAVVFFIFAASNGVSALLSIFVLNAKEIQRAYRKNDLMSQESN

SEQ ID NO: 6188 - protein, 234 aa, Lycopodium annotinum
MGRGKIEIKRIENSTSRQVTFSKRRGGLLKKAHELAVLCDAQVALIIFSNTGKLFEYASTSMKEILDRYRKYPDGIQTGRVMEYDNDVMVQHWSREVMRMKQQIERSYQTQRHMMGEDLGLLPLKELQHLEQQLDTGLNRVRARKDQVLREQIDSLRIKELQWHEENEILRRKIAGAHGMTEVAVRSFSSQNIVNPLETREPPSIGQVSVPFSLHVNQKNLRENQNLQTSLQLG

SEQ ID NO: 6189 - protein, 430 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 6190 - protein, 468 aa, Pseudomonas syringae pv. tabaci
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMSKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 6191 - protein, 158 aa, Triticum aestivum
  unsure (1)..(158): unsure at all Xaa locations
PLVRLPQVIISAIIPRSFGLSTTADDAKNYLRVIILLQYVPRIIRFVPLLGGRQSATGFIFESAWANFVINLLMFVLAGHVVGSCWYLFGLQRVXNQCLPDAGAAASVASGGVFRDCGLNFDIGGQNEQISQQWFNEPASTACFDTGNDTNFQYGIYQ

SEQ ID NO: 6192 - protein, 152 aa, Trichodesmium erythraeum IMS101
MSNWLEHSVQIEVDAPIDLVWNLWSDLEQMPQWMKWIKSVEVLQDNPELSRWKLASGNFEFSWLSRIKKIVTHQIIQWESVDGLPNRGAIRFYDRYDSSIIKLTVAYGAPGWLIKIMDNLFLGRIVESTLMADMERFRQYVIGLKQKENEES

SEQ ID NO: 6193 - protein, 130 aa, Oryza sativa
  unsure (1)..(130): unsure at all Xaa locations
DTTVATLQGLKSTAVMPVARRSGNSSLGNVSNGGRIRCMQVWPIEGMKKVETFCYLSPMTVEDLLKHIEYLLRYKWVPCLEFRQXVGSRYRENHRTRXYYDGRYWTMWKLPMFRGTDATQVLKELEEAKK

SEQ ID NO: 6194 - protein, 197 aa, Glycine max
MDFSSVRAALDSKSYDKVADVCDNLMLQVAADGIAYQDDWPYAVHLLSHIYVHDINSARFLWKSIPPSIKESQPEVTAVWKIGQKLWLRDYAGVHEAIRAFDWTQELQALVASFAELYTKEMFQLLLSAYSTISIKDTALFLGMNEDDATNYLLQQGWTVDPASRMLIVKKQPVVTEQKLDPSKLQRLTEYVFHLEH

SEQ ID NO: 6195 - protein, 233 aa, Oryza sativa (japonica cultivar-group)
MPLWGTGSSAASAAAEGSAAGGDGAARSSSGGAAVIRSLLPTRRRLRLDPPSKLFFPYEPGKQVRSAVKIKNISKSHVAFKFQTTAPKSCFMRPPGGILAPGESIIATVFKFVEHPENNEKPLDQKCKVKFKIVSLKVKGPMEYVPELFDEQKNQVAVEQILRVVFLDAERQTPQMDKLKRQLAEAEAALEARKKPPEDTGPRIVGEGLVIDEWKERRERYLARQQIEGVDSA

SEQ ID NO: 6196 - protein, 487 aa, Pseudomonas fluorescens PfO-1
MLLRKADMQLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLGI

SEQ ID NO: 6197 - protein, 482 aa, Vibrio fischeri
MSKKLTTAAGCPVAHNQNVQTAGKRGPQLLQDVWFLEKLAHFDREVIPERRMHAKGSGAYGTFTVTHDITKYTKAKLFSEIGKQTELFARFTTVAGERGAADAERDIRGFALKFYTEEGNWDLVGNNTPVFFLRDPLKFPDLNHAVKRDPRTNMRSAKNNWDFWTSLPEALHQVTIVMSDRGIPATYRHMHGFGSHTFSFINSDNERFWVKFHFKSQQGIKNLSDAEAAQVIGQDRESHQRDLLESIDNQDFPKWTLKVQIMPEADAATVPYNPFDLTKVWPHKDYPLIEVGEFELNRNPQNFFAEVEQSAFNPANVVPGISFSPDKMLQGRLFAYGDAQRYRLGVNHQHIPVNAPRCPVHSYHRDGAMRVDGNFGSTLGYEPNNEGQWAEQPDFAEPALNLDGAAAHWDHREDEDYFSQPGDLFRLMTAEQQAILFDNTARNLNGVPKEIQLRHLRHCYKADPAYGEGIGKLLDIDVSEFN

SEQ ID NO: 6198 - protein, 208 aa, Triticum aestivum
MASPHAHPATRPLSALPSLLLARSSSAAATAASSARPASLSLPLSCSRPRARAYCPARRRLPGSVVAMSSSAPTPGPVQKSEEEWEAVLTPEQFRILRRKGTEFPGTGEYDKFFDEGIYGCAGCGTPLYKSSTKFNSGCGWPAFYEGFPGAIKRTADPDGRRIEITCAACEGHLGHVFKGEGFNTPTDERHCVNSISLKFVPASEEAS

SEQ ID NO: 6199 - protein, 443 aa, Brassica napus
MGQGPSGGLNRPGDRKPDGNEKKEKKFEPAAPPSRVGRKQRKQKGPEAAARLPTVTPSTKCKLRLLKMERIKDYLLMEEEFVANQERLKPQEEKAEEDRSKVDDLRGTPMSVGNLEELIDENHAIVSSSVGPEYYVGILSFVDKDQLEPGCSILMHNKVLSVVGILQDEVDPMVSVMKVEKAPLESYADIGGLEAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDANSGGEREIQRTMLELLNQLDGFDSRGDVKVILATNRIESLDPALLRPGRIDRKIEFPLPDIKTRRRIFQIHTSKMTLSEDVNLEEFVMTKDEFSGADIKAICTEAGLLALRERRMKVTHPDFKKAKEKVMFKKKEGVPEGLYM

SEQ ID NO: 6200 - protein, 492 aa, Raphanus sativus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAISSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPSKSYTGIRTKCVIKKENNFKQAGDRYRSWAPDRQDRFVKRWVEILSELRLTHEIRSIWISYWSQADRSLGQKLASRLNVRPSI

SEQ ID NO: 6201 - protein, 309 aa, Rhizobium etli
MADLQATLDSIYTDILPRIGEGKVADYIPELAKIDPRQFGMAIVTVDGQVFRVGDADIAFSIQSISKVFMLTLALGKVGEGLWKRVGREPSGSTFNSIVQLEHESGIPRNPFINAGAIAVTDVVMAGHAPREAIGELLRFVRYLADDESITIDDKVARSETQTGYRNVALANFMRAYRNLDHPVDHVLGVYFHQCALAMSCEQLARAGLFLAARGSNPMTGHSVVSPKRARRINALMLTCGHYDGSGDFAYHVGLPGKSGVGGGIFAVAPGIASIAVWSPGLNKVGNSQLGAVALEMLAARTGWSVFGD

SEQ ID NO: 6202 - protein, 521 aa, Zea mays
  unsure (1)..(521): unsure at all Xaa locations
MVKAVVVGAAVVACAAVGVAVVLEHRRRKRDADLLGSAEAERRRRAAAVIEEVERSLATPTALLRGIADAMVAEMERGLRGDIHAQLKMLISYVDXLPTGDEHGLFXALDLGGTNFRVLRVQLGGREKRVVKQQYEEVSIPPXHLMVGTSIELFDFICCCXLAKFVDTEGEDFQLPEGRQRELGFTFSFPVNQTSISSGTLIKWTKGFSINGTIGEDAFPSMAXVGEDVVSELSRAMERQGXLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGESD

SEQ ID NO: 6203 - protein, 330 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRPGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 6204 - protein, 132 aa, Zea mays
ATVYKDQGITVIAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 6205 - protein, 585 aa, ASPERGILLUS NIDULANS FGSC A4
MDKDFLKGNPERSTSSDSTPVYGESTSRRASLGQRVLGSFQRDPNAHVTAFASFSDGKTYDIENATEKAANSPLHRSLRGRHLQMIAIGGSIGTGLFVSSGRVLATGGPASLLIAYALIGCMLYCAVHALGEMAVIFPVAGSFAHYSTRFIDPAWGFAMGWNYALQWLAILPLEIVAAAITVDYWESNISSAVWVALFWAAIVSINLFGVKGYGEAEFVFSSIKVIAVIAFIILGVILNCAGGQNGSYIGVKYWHDPGAFHHGFKGLCDVFVNAGFAFAGTELVGLAAAETANPRKSLPTAIKQVFWRITLFYIVSLTLVGLLIPYTEPRLINGTSTVDTKASPFVIAIKNAGIEVLDSVMNVVIMIAVLSVGNSAVYGSSRTLAALAEQQQAPRFLGYIDRKGRPLWAICIASAMGLLGFLAATDKQEVAFEWMIAISGLSSIFTWGSICLAHIRFRRAWKVQGNSLHDLAFRSQPGIIGSWIGFAFNCLVLVAQFWVGFAPIDYETMSASMLARNFFSKYLAAPVVLLFYIPYKLRFKTKILRAKDMDLRTGRRELNIQWLMKEERAQQAAWPAWKKIYKFFC

SEQ ID NO: 6206 - protein, 199 aa, Zea mays
  unsure (1)..(199): unsure at all Xaa locations
SERFTNFCQGKLTSSPWSELDGHRXSLSLVEDQLVNINQKGFLTINSQPAVNGEKSDSPTVGWGGPGGYVYQKAYLEFFCAKEKLDQLIEKIKAFPSLTYIAVNKDGETFSNISPNAVNAVTWGVFPGKEIIQPTVVDHASFMVWKDEAFEIWTRGWGCMFPEGDSSRELLEKVQKTYYLVSLVDNDYVQGDLFAAFKI

SEQ ID NO: 6207 - protein, 109 aa, Oryza sativa (japonica cultivar-group)
MVVVAPKGCVTVRVGAEGEEQRRFAVPLAHLKHPLFGALLEEAEREYGFAQRGAIAIPCRVDRFVHVEHLIVQDLHGAAASHLLDLDSSSHHHTQIHLHLPRFAGCFRA

SEQ ID NO: 6208 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMAPFGPYWKFVRKLIMNDLLNATTVNKLRPLRTQQIRKFLRVMAQGAEAQKPLDLTEELLKWTNSTTSMMMLGEAEEIRDIAREVLKIFGEYSLTDFIRPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDSKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 6209 - protein, 355 aa, Oryza sativa
MNCSYVKDYEFVVIFDADFQPQADFLKRTVPHFKGNEDVGLVQARWSFVNKDENLLTRLQNINLCFHFEVEQQVNGVFLNFFGFNGTAGVWRIKALEDSGGWMERTTVEDMDIAVRAHLKGWKFLYINDVECQCELPESYEAYRKQQHRWHSGPMQLFRLCFVDIIKSKQIGVWKKFNLIFLFFLLRKLILPFYSFTLFCIILPMTMFVPEAELPAWVVCYIPATMSLLNILPAPKSFPFIVPYLLFENTMSVTKFNAMISGLFQLGSAYEWVVTKKVGSAPNLDSLAKESHPKKDSKKKKHNRIYQKELALSFLLLTAAARSLLSVQGIHFYFLLFQGVSFLVVGLDLIGEQVE

SEQ ID NO: 6210 - protein, 518 aa, Agrobacterium tumefaciens str. C58 (Cereon)
MADWLVFFLSGEKGMDSSSSGVSYKKADASYFEKRGLSRYAGVWSLWALGVGAVISGHFSGWNFGFSTGGWGGMLVAGIIIAIMYLGLTFSIAEMSPALPHTGAAYSFARTAMGPWGGFVTGLCENVEYVLTPAVVVTFITAYVNSILGLDPAYSPFVWIVFYAIFLALNVFGLELSFKVTLVITLISLAVLVFFWISAIPNIDFSRFALNIGVGPDGKAVELPEGGGSFFPFGFSGVLATLPFAVWLFLAIEQLPLAAEESVDPKRDMPKGIILGMVTLMVSAFMIVLLNPSLPGVGAFHLSSSLEPLLDGFKAIYGDGGVVLLGLVALTGLIASFHTILYAQGRQIYSLSRAGYFPTVLSITHSKYRTPYVANITGAIVGLAVMLVIWFSLGAEQGGSIIGSVLLNMAVFGAMFSYIMQAISFILLRKNLPNIERPFRSPFGIPGALLTIIIAIVTLLYQIQDPNFTKGVLWVAVWFAVAIAYFAFVGRHRLILSPEEEFALEHKQAAVAAAAAKA

SEQ ID NO: 6211 - protein, 504 aa, Nitrosomonas europaea ATCC 19718
MRFFRLLKIILIAFRFGLDEILFTQVRLRILKVFSALLPFRSRLQLPRAVRLRLALETLGPIFIKFGQMLSTRRDLLAQDFAEELALLQDRVPPFPSEQAVQILETVYGRPVHEVFLEFDIKPVASASVAQVHYAVLHDGTRAAVKILRPTIAPVIAHDVALMETGAWLLESIWPDGKRLKLREVVAEFARHLGDELDLIREAANCSQLRRNFLDSPLLLVPEVYWDYCHTEVMVMERVVGTPISHVASLRTQGIDIPQLARMGVEIFFTQVFRDGYFHADMHPGNIFVGSDGRYIAVDFGIMGSLSDQDKNYLAQNFLAFFRRDYRRVAQTHIEAGWAPRNTRVDDFESAIRAVCEPIFDRPLKEIYFGRVLLRLFQASRQFNVEIQPQLVLLQKTLLNIEGLGRDLDPDLDLWKTAKPFLENWMAEQVGLRGLVTHLQKEATNWAVILPQFPRLLHYNLSQERAQNLEDRLAQLVAQEKRQSRLLMLLALLLAGLLLAQIYL

SEQ ID NO: 6212 - protein, 275 aa, Xanthomonas campestris pv. campestris str. ATCC 33913
MTHLSFEFYPPKTDDQRAQLDRTAAKLKAYAPEYVSCTFGAGGSTLSYTSETVRHLKQKHGFEAAPHLSCVGGSRQEIRELLKLYRAIGCTRIVALRGDLPSGMGHPGDLRYASDLIAFIRAEHGDAFRIEVGAYPETHPQAIDADSDLKYFKAKVDAGADAAITQYFYNADAYFHFRDAAQRLGVEVPIIPGIMPISNFSQLRRFSEQCGAEIPRWIGKKMQSYGDDADAVRAFGAEVVAGLCERLIAGGVPALHFYTLNLAKPTTQVLQLLGR

SEQ ID NO: 6213 - protein, 314 aa, Neurospora crassa
MTTLTGKTILITGGTRGLGAVTALALARLGPHKIYITGRPSSSATADTLISKIRSEAESNPNANNVCTNITFLPTDNASLASVSATAQKLLETEEKIDILICNAGIAAIPLGKSEDGYEIQFATNVLGHALLIRKLLPLLRKSTSSGARIISLGSYGYRMAKTVDLERVSGDGLAKDKDDFLGYQRWRRYTESKLANTLYTSQLAKQYPEITSVTVTPGFVESDMVKNFGFVDHWMTKLGAKLARGQKGMVTVEEGAENTVWAATVEAKELVNGGLYDPVGKRVPEGELTAAARDEALAKKLWDWTEAELKRWL

SEQ ID NO: 6214 - protein, 307 aa, Synechocystis sp. PCC 6803; identical to SEQ ID NO: 299

SEQ ID NO: 6215 - protein, 201 aa, Capsicum annuum
ARVDFEFLGNTTGEPYTVQTNVYVNGVGNREQRLNLWFDPSKDFHSYSILWNQRQVVFLVDETPVRVHSNLEHKGIPFPKDQPMGVYSSIWNADDWATQGGRVKTDWSHAPFVASYKGFEINGCECPATAAVAENTQRCSSNGQKRYWWDEPVMSELSVHQSHQLIWVRANHMVYDYCTDTARFPVAPVECQHHQHKTTHN

SEQ ID NO: 6216 - protein, 228 aa, Streptomyces avermitilis MA-4680
MAVQINPSILSADFARLAEEAKAVEGADWLHVDVMDNHFVPNLTLGVPIVEALARATDTPLDCHLMIEDADRWAPQYVEAGAGSVTFHAEAAAAPVRLAREIRAKGARASMALKPATPIEPYEDLLPELDMLLIMTVEPGFGGQAFLDIMLPKIRRTRELISKHGLELWLQVDGGVSASTIERCAEAGADVFVAGSAVYGAADPADAVRALRTQAEGATALASWACDH

SEQ ID NO: 6217 - protein, 444 aa, Glycine max
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 6218 - protein, 463 aa, Gluconacetobacter diazotrophicus
MSLPRTIRTFSPRGTTIALATLAGAALPAMAAPAMAADPAPPAINTGDTAWMLVSTALVLMMTVPGLALFYGGMVRKKNVLATLMQSFAICCIVTIVWMVAGYSLAFGTGSPYIGDLSRFMLNGIGAQISKGSDVGFTLGLGSANATVMTIPESVFMMFQMTFAIITPALITGAFAERMKFSALCVFTILWSLLVYAPVAHWVWSPLGWVAGFGAIDFAGGTVVHINAGVAGLVTALVVGKRQGYGQDDMSPFNLTYAVIGASLLWVGWFGFNAGSAVGANGRAGMAMATTQIASAAAGVAWMLAEWARTGKPTVLGIISGAVGGLVAITPAAGFVLPGGALIIGLLAGAVCHWTATTMKHMLGYDDSLDAFGVHGIGGILGALLTGVLAYGPLSATDANPAGVVGSFAQLVTQAKAVGVTIVWCAVVTFVLLKIVDLAIGLRVRSEDEIEGLDMTQHGERIN

SEQ ID NO: 6219 - protein, 219 aa, Corynebacterium glutamicum ATCC 13032
MAQRTPLIAPSILAADFSRLGEQVLAVPDADWIHVDIMDGHFVPNLSFGADITAAVNRVTDKELDVHLMIENPEKWVDNYIDAGADCIVFHVEATEGHVELAKYIRSKGVRAGFSLRPGTPIEDYLDDLEHFDEVIVMSVEPGFGGQSFMPEQLEKVRTLRKVIDERGLNTVIEIDGGISAKTIKQAADAGVDAFVAGSAVYGAEDPNKAIQELRALAQ

SEQ ID NO: 6220 - protein, 346 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVTATVGI

SEQ ID NO: 6221 - protein, 555 aa, Streptomyces clavuligerus
MATTTAKAMLERLHQYGVDHVFGVVGREASAILFDEVEGLDFVLTRHEFTAGVMADVLARITNRPQACFATLGPGMTNLATGVATSALDRSSVIALAAQSESYDCYPNVTHQCLDSTAVMGPLTKFSVQLERGEDIVNLVDSAVLNSRIEPVGPSFISLPVDLLGAELNGTPTDAPLVRATATHALDADWRARLDEAAELVREAENPLLVVGSAVIRAGAVDALRALAERLNIPVVTTYTAKGVLPHDHPLNYGAISGYMDGILGHPALDEIFGPADLLLAIGYDYAEDLRPSMWTRGRAKTTVRVAPEVNPIPELFRADIDIVTNVAEFVTALDDATSGLAPKTRHDLSALRARVAEFLADPTEYEDGMRVHQVIDCMNSVLDNGTFVSDIGFFRHYGVLFAKSDQPYGFLTSAGCSSFGYGLPAAMAAQIARPGEPVFLIAGDGGFHSNSADIETAVRLGLPIVMVVVNNDRNGLIELYQNLGHQRSHAPAVGFGSVDFVQLAEANGCEAVRATDRTSLLAALTKGAGLGRPFLIEVPVAYDFQSGGFAALAI

SEQ ID NO: 6222 - protein, 312 aa, Pyrococcus furiosus DSM 3638
MIYAIGEILIDFIAKEEGKLKDVREFEKHPGGAPANVVVGLRRLGAKSALISKVGDDPFGEFLIEELKKERVETKYIIKDTNKHTGIVFVQLIGAKPEFILYDGVAYFNLRKEEIQWDFMRDAELLHFGSVLFAREPSRSTVFEVLRAVKGKVPISYDVNIRLDLWRGREKEMLKDIEEALKLADIVKIGDGELEYLNKNGIALEDFNFALVAITRGAEGSTIIHKDIRVDVPSFKVEPVDTTGAGDAFMAALLASLFYMGKLDILEFSKEELKELGSFANLVAALSTTKRGAWSVPSLEEVLKHRKFSFLP

SEQ ID NO: 6223 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 6224 - protein, 516 aa, Leptospira interrogans serovar lai str. 56601
MLTVVTILFLAIYGIDIVALFFFGIHTYIMVYLYKKNHTYCESEPDKILDINNPNLPVVTVQLPIFNEYYVVDRLIETTVALKYPKDKLEIQLLDDSTDETVEKSRNLINHYKSLGFDIHHLHRSGAERTGHKAGALEAGMKVARGEYIAIFDADFMPNPDFLIKTVPYFDDPQIGMVQVRWGHINADYNVLTKAQSFGIDGHFMIEQVARNGSHLWMNFNGTAGIWKKECIIDSGGWEHDTLTEDFDLSYRAEMKGWKFRYFKDIECKAEIPAMISAYKSQQFRWCKGSIQTAVKLLPRILRADLPWRIKSEAIVHLINYSVHPLMVINILFSAPLLLMDYWSGFSFYDLPIEILMGTAAILSVGSVGPMIFYAYSQKILHKDWKKRMLYLPILIMIGTGIAIVNTRAWLEAILGIQSSFKRTPKLKIEKNTDILKERLKYTVPLDFHVVLEFLMGFYCIGTVFLSFALGKPQIVGFLMIYALGFFYVGYLSLKDALWKLGASKQESAKELSTQA

SEQ ID NO: 6225 - protein, 405 aa, Zea mays
PPPPSHWPVRPGIRWPWGGPMCEAGVVVSTGKIPVVCSMFYTFIKALIVISLLLLAVEVAAYFNGWDLAASALALPAIGLESLYASWLRFRATYVAPGIQFLTDACVVLFLIQSADRLIQCLGCFYIHIKRIKPKPKSLALPDAEDPDAGYYPMVLVQIPMCNEKEVYQQSIAAVCNLDWPKSNFLVQVLDDSDDPLTQTLIREEVAKWQQQGARIVYRHRVLRDGYKAGNLKSAMSCSYVKEYEFVAIFDADFQPHPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKV

SEQ ID NO: 6226 - protein, 387 aa, Corynebacterium efficiens YS-314
MRNKYVVERLRPFGETIFATMTQRANEAGAINLGQGFPDEDGPAPMLEIASQQILGGNNQYSGGRGDLGLRTAVASDRHKRFKLDYDPDTEVLITVGATEAISASVLGLVEPGDEVIVLEPYYDAYAAAIALAGATRVAVPLKEEDNTWVLDTDAVHAAVTKKTSMIIVNSPHNPTGSVFSKRSLEALAGIARAYDLLVLSDEVYEHLTFDKVSHTAVASLPGMWDRTITVSSAAKTFNVTGWKTGWALAPAPILEAVIRAKQFMSYVGATPFQPAVAHAVAHEKPWVKQMRKGLQNKRDILTDALTQAGLKVHDSHGTYFVVADIGERDGAEFCFDLIDRVGVAAIPVQAFVDKPEQWSSKVRFAFCKQEDTLREAAQRLRAAGSL

SEQ ID NO: 6227 - protein, 842 aa, Nostoc punctiforme
MRAVLMAGGSGTRLRPLTCDLPKPMVPILNRPIAEHIINLLKRHQITEVIATLHYLPDVLRDYFQDGSDFGVQMTYAVEEDQPLGTAGCVKNIAELLDETFLVISGDSITDFDLTAAIAFHKQNKSKATLILTRVPNPIEFGVVITDEERRIRRFLEKPSSSEIFSDTVNTGTYILEPEVLEYLPANIECDFSKDLFPLLLAKDEPMYGYIAQGYWCDVGHLDAYREAQYDALDRKVNLDFAYKEVSHELWVGQNTYIDHTAVIETPAVIGDNCRIGARVQIEAGTVIGDNVTIGADANLKRPIVWNGAFIGDEAHLSACVISRGARVDRRAHVLEAAVVGSLSTVGEEAQISPGVRVWPSKKIESGAVLNINLIWGNTAQRNLFGQRGVQGLANIDITPEFAVKLGSAYGSTLKPGSKVTVSRDQRNVSRMVTRSLIAGLMSVGIDIQNLDATAIPIARTVIPTMSVAGGIHVRVHPDRPDYILIEFMDAKGINISKALEKKIEGAYFKEDMRRALIHEIGDVSYPSQVMDRYCTAFEKLLHVHTLRNSRAKVVIDYVYAVSGAVLPQMLDKFGADAVVLNASVNKSAMSITDREGLLTQLGHVVEALKANFGVQVSANGEQLILVDESGYPIRGETLTALMVDMILTANPRGTVVVPVHASSAIEQVARRHDGRVIRTKANPTALMEACQKNPNVVLGGSGETGFIFPQLHPGFDSMFCIAKIIEMLTIQERSLAAARSELPRVIHKTYTVRCPWTAKGALMRYLVETHPAQNLELIDGVKICQPYDDSWLLVLPDASEPLVHLYANSNDREWVDETVRNYRTRVQSFVERQQEYQPAEM

SEQ ID NO: 6228 - protein, 108 aa, Zea mays
  unsure (1)..(108): unsure at all Xaa locations
SLRTNTLWVNLKAIYTLVGAAALKRESLSNPSEGDGVKVARLLTETGSALRLFDITTGTNVTRSRLLPVTATCDLXLVQPDLYTLTEGFVIRCPXERSSANASIELGP

SEQ ID NO: 6229 - protein, 341 aa, Glycine max
  unsure (1)..(341): unsure at all Xaa locations
MGKVKIGINGFGRIGRLVARVALQRDDVELXVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSXMPPCIVVGVNEHEYKPELDIISNASCTTNCLAPLXAKVINDRFGIVEGLMTTVHSITATXQKTVDGPSAKDWRGGRAASFNIIPSSTGAAKAVGKVLPALNGKLTGMAFRVPAVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 6230 - protein, 367 aa, Pseudomonas syringae pv. syringae B728a
MHKIEDVMSKQILILPGDGIGPEIMTEAVKVLELANEKYQLGFELTHDVIGGAAIDKHGVPLADETLERARAADAVLLGAVGGPKWDTIERDIRPERGLLKIRSQLGLFGNLRPAILYPQLADASSLKPEIVAGLDIMIVRELTGGIYFGAPRGTRVLDNGERQAYDTLPYSESEIRRIAKVGFDMAMVRGKKLCSVDKANVLASSQLWREIVEQVARDYPEVELSHMYVDNAAMQLVRAPKQFDVIVTDNLFGDILSDQASMLTGSIGMLPSASLDTANKGMYEPCHGSAPDIAGKGIANPLATILSVSMMLRYSFNLTDAADAIEKAVSLVLDQGIRTGDIWSEGKVKVGTQEMGDAVVAALRNL

SEQ ID NO: 6231 - protein, 512 aa, Salmonella typhimurium LT2
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 6232 - protein, 215 aa, Synechocystis sp. PCC 6803
MSADPNRIVRLLPLGAGSLGGLLLLINRLSTPMLNPSQARSDVVGVILAGMLVCVWLIWQRIQPKSPEAVVLEGKEGFDLLDSLPQEIKTELAWASHLLLTNTVTQTMVVYYDRQVLLRRGILSEQKEVKPGPIVERVMQTQKPVYLVNLPLYPGRVEFDYLPANTQGLICQPLDDRGVLILGANIPRSYTKQDENWVTGIADKIAHSLSMPINA

SEQ ID NO: 6233 - protein, 403 aa, Glycine max
NFSSSQLRIITQIEIEFKVKFGKTNLCHCTFTDLRLRASLCRSSVRKAVTISPLTTTKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 6234 - protein, 505 aa, Oryza sativa
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 6235 - protein, 138 aa, Vibrio vulnificus CMCP6
MTKESKVVLKSDQQWREQLSEQEYHVCREQGTEPPFSGKLLHNKDSGEYACTCCHAPLFSSVNKYDSGCGWPSFDAPINETAVLYLDDFSHGMKRVEIRCARCDSHLGHVFPDGPKTTGERFCVNSVSLIFNKIETNE

SEQ ID NO: 6236 - protein, 498 aa, Glycine max
MAHSSVIVFLCTLLLFFSPSIRASDDDVALHAKKLIRDLNLFPDADVNIVPVANCTLQPRRIVEKRLRFPKLLASDSEPSVEDLGHHAGYYPIQHSHAARMFYFFFESRNRKEDPVVIWLTGGPGCSSELALFYENGPFKIADNLSLVWNEYGWDKASNLLYVDQPTGTGFSYSSDLRDIRHNEEGVSNDLYDFIQAFFVEHPQYAKNDFFITGESYAGHYIPAFATRIHRGNKAKEGIHINLKGLAIGNGLTNPAIQYKAYPDYALEMGIIKKATRNLLNLVLVPACESAIKLCGTNGKTSCMAAYVVCNVIFSDIMLHAGDTNYYDIRKKCEGSLCYDFSNMDKFLNQQSVRDSLGVGKIHFVSCSTEVYAAMLVDWMRNLEVGIPDLLEDGINLLVYAGEYDLICNWLGNSRWVHAMEWSGQKEFATSLEVPFVVDGSEAGLLKSYGPLSFLKVHNAGHMVPMDQPKAALEMLKKWINGTLAEPRDDKEKLVAEM

SEQ ID NO: 6237 - protein, 392 aa, Triticum aestivum
MENMRSENHRGAAMEGVKLASEAAANTNRRALRDIKNILGAPHQPQAVSKRGLQEKPAAAGAKSQPGAVGHRPVTRKFAAILQQTQPANAPLAPIGSERQKRNADTAFNAPSDMECSKASDDDLDEMMTNELKEIDMEDTEEEEMPDIDSCDVGNSLAVVEYVDEIYSFYRRTEELSCVSPTYMAHQSDINEKMRGILVDWLIEVHYKLELLGETLFLTVNIIDRYLARENVARKKLQLVGVTAMLLASKYEEVSVPVVEDLILICDRAYSREDILDMERTIVDRLEFNMSVPTPYCFMRRFLKAAGSDKKLELLSLFLIELSLVDYKMLKFQPSMLAAAAIYTAQCTLNGCVSWSKCCELHTKYSEEQLMDCTTMMVELHRGAARGKLTGV

SEQ ID NO: 6238 - protein, 392 aa, Zea mays
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEARATYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKISMPAHLMFDGQDDKLFEHFSMVAQRLGVYTARDYADILEFLVDRWKVADLTGLSGEGNKAQDYLCTLASRIRRLDERAQSRAKKAGTLPFSWVYGREVQL

SEQ ID NO: 6239 - protein, 356 aa, Magnaporthe grisea
MMGACMSASSEESEQKKRSQKIDKDLEEDSKRLRRECKILLLGSGESGKSTIVKQMKIIHLKGYSDDELYNYRPTVFKNLIECAKAVISAMRQFDIEPQLEGNKELCDYLLDYMVESGPQAEIDPKVGQAVQSIWNDPAREQLMDRQTEFYLMDSAEYFFQEVLRIVSPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKADKYLLWRFNQVNRAHLNLYPHLTQATDTSNIRLVFAAVKETILNNALKDSGIL

SEQ ID NO: 6240 - protein, 133 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 6241 - protein, 493 aa, Microbotryum violaceum
MVNVAYDTTGTLVANVDGTQTVYNGGDMAWVLVAGVLVMIMSPGVGFLYSGLLRRKNALSMMMLGVLVYAVITIQWFFWGYSLAFSSTGSAFIGDLKHFGLMNVTLEPSAGSSKIPALLYYFYQSMFATVTVVILVGGIAERARILPLLIFCFCWATIVYDPIANWVWNPNGWLYKLGELDFAGGGPVHITSGTAGFAWSLYLGRRRGYGTAKLAYRPHSVFQIILGTVFLWFGWFGFNGGSELAMNLRAVQASTVTNIAAAMGGITWFAMDWFYTKKWSAVSMCSGILAGLVGITPAAGYIGSPAALAIGFLTAIACNFGTGLKVLLGIDDAVDSFALHAIGGYCGSALTALFADSRVAGFDGYTEIPGGWINHNYIQLGWQLAGATTIMAYTFVVTYLLLFVIDHIPGLKLRATEDMEILGIDETELGENAYDFVFRNRDLENPEEFSELHNRATGEDLSRQVSHHSSSSHNKDIKSPHSAVPVTEEKLSV

SEQ ID NO: 6242 - protein, 310 aa, Staphylococcus haemolyticus
GFGRIGRLAFRRIQDVGGIEVVAVNDLTDDEMLAHLLKYDTMQGRFTGEVEVVDGGFRVNGKEVKSYEEPDASKLPWGDLDIDVVLECTGFYTDKEKAEAHINAGAKKVLISAPAQGDVKTIVFNTNHNDLDGSETVVSGASCTTNSLAPVAKVLSDEFGLVEGLMTTIHAYTGDQMTQDGPHKKGDKRRARAAAQNIVPNSTGAAKAIGKVIPEIDGKLDGGAQRVPVATGSLTEVTVVLEKDVTVEDVNKAMKNASNESFGYTEDEIVSSDVVGMTYGSLFDATQTRVMSVGDRQLVKVAAWYDNEMS

SEQ ID NO: 6243 - protein, 488 aa, Pleurochrysis carterae
MSQAVETRTRIKSERYESGVIPYAKMGYWDPEYSIKETDILALFRCTPQPGVDPVEAAAALAGESSTATWTVVWTDLLTACDLYRAKAYRVDPVPSAADTYFCYIAYDIDLFEEGSLANLTASIIGNIFGFKAVKALRLEDMRMPYALLKTYQGPATGLIVERERLDKFGRPLLGATVKPKLGLSGKNYGRVVFEGLKGGLDFLKDDENINSQPFMRYRERFLYSMEGVNHAAAVSGEVKGHYLNATAATMEDMYERAEFAKDLGSVIVMIDLVIGYTAIQSMAIWARKTDMILHLHRAGNSTYSRQKSHGMNFRVICKWMRMSGVDHIHAGTVVGKLEGDPLMIKGFYNTLLEFKSDINLPQGLFFAQDWASLRKCVPVASGGIHCGQMHQLINYLGDDVVLQFGGGTIGHPDGIQAGATANRVALECMVIARNEGRDYISEGPQILRDAAKTCGPLQTALDLWKDITFNYASTDTADFVETPTANR

SEQ ID NO: 6244 - protein, 287 aa, Vibrio furnissii
MYLISSREMLKRAQQGGYAVPAFNIHNLETVQVVVETASEMGSPVILAGTPGTYEYAGTDYLISICKEAAHKHAIPLVLHLDHHEALPDIRSKVEHGIRSVMIDGSHYAFEQNIEVVKSVVAFCNRFDASVEAELGRLGGQEDDLIVDSADSLMTDPASAAEFVRRTGIDSLAVAIGTAHGLYKAEPHLDFDRLEKIQSVVDIPLVLHGASGVPDDMVRRAIALGVCKVNVATELKIAFSNAVKTHFSEHPDANDPRKYITPGKAAMKRVVMDKIRLCGSEGQLSSR

SEQ ID NO: 6245 - protein, 128 aa, Triticum aestivum
MAGACAVAAPSRPTVSGPGAALPPGRGFRVSCRRSARRRAGGRARVSRDTDGAEAEPDSKGRIPQDDSGYLLTLGLGSVGGAAAVKYGSVLLPDITRPNIVEALLMVSLPMAAAVLVLLKLSSTSTHD

SEQ ID NO: 6246 - protein, 144 aa, Oryza sativa
MAPSTALSPVAFKSSFSPLLFNPTRSKINVEGIFGNMQNLYETVKKAQMVVQVEAVRVQKELAATEIDGYCEGELIKVTLSGNQQPVRVEITEAAMEVGAEKLSELVNDAYKDAHQRSVQAMKERMADLAQSLGMPAGLGDGLK

SEQ ID NO: 6247 - protein, 553 aa, Zea mays
  unsure (1)..(553): unsure at all Xaa locations
ALPLPALRLPRSPSPRTGHLPSPSAVVRSVPDCIYFPQLLLQFSLAHVAPAFQVLVAGDLVYHLXRELLRDFRGSRRLQRIGERKVRCQLILLVVPKVGLSAANYAKNLLRVTVLLQYVPRIIRFVPLLDGQSTNGFIFESAWANFVINLLMFILAGHVVGSCWYLFGLQRVNQCLRDACSISTIPYCDSFIDCGRGIGSGLYRQQWFNDSGAEACFNTGNDATFQYGIYEQAVLLTTEDSAVKRYIYSLFWGFQQISTLAGNLVPSYFIWEVLFTMAIIGLGLLLFALLIGNMQNFLQALGRRRLEMQLRRRDVEKWMSHRRLPEDLRRRVRRAERFTWAATQGVNEEELLSNLPEDIQRDIRRHFFRFLNKVRLFTLMDWPILDAICDKLRQNLYISGSDILYQGGTVEKMVFIVRGKLESISADGSKAPLHDGDVCGEELLTWYLEHSSANRDGGKIKFQGMRLVAIRTVRCLTNVEAFVLRASDLEEVTSQFARFLRNPRVQGAIRYESPYWRTIAATRIQVAWRYRKRRLKRAEKSRLSEETYASLGS

SEQ ID NO: 6248 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 6249 - protein, 373 aa, Arabidopsis thaliana
MAKEIESATDLGDTNIKGVLVHGGRYFQYNVYGNLFEVSNKYVPPIRPIGRGASVLSVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANARKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 6250 - protein, 634 aa, Pseudomonas aeruginosa PAO1
MSDAATRAEETSEGHSSSAIGLMVGAVGVCYGDIGTSPLYTLKEVFIGGYGVQANHDGVLGVLSLIFWSLVWVVSIKYVIFVLRADNQGEGGVMALSALARRAAAPFGRLQTFVVVAGLIGAALFYGDSMITPAISVLSAVEGLEIAFDGLEHWTVPLALIVLIGLFLIQKHGTARIGILFGPVMVLWFGALAALGVYGVIQQPEVLQAMNPVWAVRFFSSHPGIGVAILGATVLALTGAEALYADMGHFGRKPIARAWFLLVLPALVLNYFGQGATILSNAEAARNPFYLLAPGWALLPMVALSTLATVIASQAVISGAFSLTRQAIQLGYVPRMTIQHTSSHEQGQIYIGGVNWALMVGVVLLVLGFESSASLAAAYGVAVTGTMLITTLLMGVVIWRLWKWPLWLGVPFFCVMLAVDSLFFAANLPKVIQGGAFPVIAGIVIFILMSTWKRGRQLLVERLDEGSLPLSVFISSMRVQPPHRVQGTAVFLTARTDAVPHALLHNLLHNQVLHEQVVLLTVVNEDSPRVSPDRRFEVEAYGDGFFRVILHFGFMEEPDIPAALRLCHLNELDFSPMRTTYFLSRETVIPSKRIGMARWREGLFAFLLKNANGNLRYFNLPLNRVIELGTQVEI

SEQ ID NO: 6251 - protein, 875 aa, Flammulina velutipes
MASSSSPSPTVPAKLDKQLDVLLIDNFDSFTWNLYQQLCLLGAKVEVIRNDEITADTLPLIKLNSLIISPGPGHPQTDSGISRAAIEYFSGKVPIFGVCMGLECLVDALGGEIAYAGEIMHGKVSRIRHDGRGCFQGIQQGIKSTRYHSLSAAHTSLPDDLAISATTEESGVIMGVRHRKYTIEAVQYHPESILSEAGDTLMRNFLALRGGTWDENPEAKVLDTSLPPFIVETASKNGVKNSHRLPSILEKIYAQRLSDVAHAQATAGTTLADLRTLHSLNIAPPSIPFVQRLIQGVKGHPALIAEVKRASPSKGPISLTTSPANQALTYALSGANAVSVLTEPKWFLGSLQDMLHARLSVGNLPNRPAILRKDFILSRYQVLESRIWGADTLLLIVAMLPEPLLRDLYKYSVELGMEPLVEVNNVKEMELALSLNAKAIGINNRNLHDFKVDMDTTTRLLDMAKGHDVVICALSGISNATEVNKYASQGVGAVLIGESLMRAKDPSAFIRQLFTLPPQPTLQPPSWCSSPPLVKICGIRSTEEALVIAEAGADMLGLMFVEKSKRFVPLDTARQISECIRSLRFSSNTTYPALADESLNTPWFTSHANRLTSTTSITPLLVGVFQDQSLATILHAVAHCQLDVVQLHGSEPVEWAQHIPVPVIKVFHLSGTTGVDGITRGGAHQFILLDSVREDGSGVSGGSGKVVDLVFAKSVVDAGEIVLDGGASYKGNEAPPVVQETSDVAEEATTPEAEQLPQEASPATTPEKPEASIEPAAQPSDSAQSDAGLVNGNKKQVNGTTTPPKYPLPIILAGGLTPENVAGAIEQVHPWAVDVSGGVELEDGSGKDLHKVLAFIANVKGKGKTVVTTESEGDD

SEQ ID NO: 6252 - protein, 76 aa, Zea mays
  unsure (1)..(76): unsure at all Xaa locations
MQNGHGTHDDTQKTAEKHSNSNIDIHALNHRQYPRIDTRDFLPLTTGGKSGMAGXDPPGHGDVCPTLNNTGKLDIA

SEQ ID NO: 6253 - protein, 262 aa, Photobacterium profundum
MIWRKTMRHPVVMGNWKLNGSKEMVVNLLNGLNAELEGVTGVDVAVAPPALFIDLAEHTLTEAGSAIILGAQNSDLNNSGAFTGDMSPAMLKEFGASHIIIGHSERREYHNESDEFVAKKFAFLKENGLTPVLCIGESDAQNEAGETMAVCARQLDAVINTQGVEALEGAIIAYEPIWAIGTGKAATAEDAQRIHAQIRAHIAEKSEEVAKNLVIQYGGSVKPENAAAYFAQPDIDGALVGGAALDAKSFAAIAKAAAEAKA

SEQ ID NO: 6254 - protein, 368 aa, Mycobacterium tuberculosis H37Rv
MTSGSLQFTVLRAVNPATDAQRESMLREPGFGKYHTDHMVSIDYAEGRGWHNARVIPYGPIELDPSAIVLHYAQEVFEGLKAYRWADGSIVSFRADANAARLRSSARRLAIPELPDAVFIESLRQLIAVDKAWVPGAGGEEALYLRPFIFATEPGLGVRPATQYRYLLIASPAGAYFKGGIAPVSVWVSTEYVRACPGGTGAAKFGGNYAASLLAQAEAAENGCDQVVWLDAVERRYIEEMGGMNIFFVLGSGGSARLVTPELSGSLLPGITRDSLLQLAIDAGFAVEERRIDIDEWQKKAAAGEITEVFACGTAAVITPVARVRHGASEFRIADGQPGEVTMALRDTLTGIQRGTFADTHGWMARLG

SEQ ID NO: 6255 - protein, 139 aa, Zea mays
MARSRLSSRSNIITRPFSAGFSRLISTDTTPITIETSLPFTAHLCDPPSRSVESSSQELLDFFRTMALMRRMEIAADSLYKAKLIRGFCHLYDGQEAVAIGMEAAITKKDAIITAYRDHCIFLGRGGSLHEVFSELMGR

SEQ ID NO: 6256 - protein, 494 aa, Hordeum vulgare
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 6257 - protein, 830 aa, Triticum aestivum
  unsure (1)..(830): unsure at all Xaa locations
MSAADKVKPAASPASEDPSAIAGNISYHAQYSPHFSPLAFGPEQAFYATAESVRDHLLQRWNDTYLHFHKTDPKQTYYLSMENRKGRTLNQRVGHXKMAGAYRFAKQMLDVARDTIARNDSFAVLSNGXLGXLASRFLDLMATLNLPSWGYGLRYRYGLFKQRIAKEGQEEIAEDWLDKFSPWEIVRHDVVYPIRFFGHVEISPDGKRKWAGGEVLNALAYDVPIPGYKTKNAISLRLWDATATAEDFNLFQFNDGQYESAAQLHSRATTSFPFRCQSKIRLAGLMVRKGKMACSSQTPRLXKKPNSLSGVVLSAPTTTLLSWIPLKGTLDLGVVMTSLLAMTSXSYIEAQARVDEAYKDKKKWIKMSXLEHGWKRQVQQRPHHRPICEGDLGHFGLPCSMKRRRDQAVLDDDAWHXSMRVLDNNPETPAAGMANLCVVAGHTVNGVAELHSNILKQELFADYVSIWPNKFQNKTNGITPRRWLRFCNPELSEIVTKWLKTDQWTSNLDLLTGLRKFADDEKLHAEWAAAKLASKKRLAKHVLDVTGVTIDPDSLFDIQIKRIHEYKRQLMNILGAVYRYKKLKEMSAADRQKVTPRTVMVGGKAFATYTNAKRIVKLVNDVGAVVNNDADVNKYLKVVFIPNYNVSVAEVLIPGSELSQHISTAGMEASGTSNMKFSLNGCVIIGTLDGANVEIREEVGQDNFFLFGAKADQVAGLRKDRENGLFKPDPRFEEAKQFIRSGAFGTYDYTPLLDSLEGNTGFGRGDYFLVGYDFPSYIDAQARVDEAYKDKKKWVKMSILNTAGSGKFSSDRTIDQYAKEIWGISACPVP

SEQ ID NO: 6258 - protein, 214 aa, Hordeum vulgare
MSMACGLCGASNCPYHMMSPVLLHHHHHQEHRQREYQFFAQGHHHHHHGAAADYPPPQPPPANCHHRRSWATLFHETAAPVNSTRLTQEVDAGGQQMAHLLQPPAPPRATIVPFRRSAFTNTISNATIMTIDTEMMAGTAYSPTMQEREAKVMRYREKRKKRRYDKQIRYESRKAYAELRPRVNGRFVKVPEAAASPSPPASPHDPSELHLGWF

SEQ ID NO: 6259 - protein, 316 aa, Buchnera aphidicola str. Bp (Baizongia pistaciae)
MNQLECLKKYTDIVVDSGDLVSINKFKLGDVTTNPSLIRQVMSLQKYQYIIYDSIRYAKKKGGSHKFKLENAIDKVSVILGSEILKNISGKISTEIDSRLSFNTNLCIERAKKLISMYEEHDIHRDRVLIKLAATWESVSAAKELKKENIQSNLTLLFSFAQAKICAEAGVFLISPFVGRIYDWYKSKSLIKSAMIDDDPGVNAVRKIYQYYKEYGYHTIIMGASFRNVDQVLALSGCDRLTISPNLLHKLQLSDDLVIRKLIPPKHKKLQPVCMSKSEFCWFHNEDAMAVEKLSEGIRQFGKDQQELENIINNNF

SEQ ID NO: 6260 - protein, 371 aa, Enterococcus faecalis V583
MAKAKKQKPIDFKELMAKVDADFPTFQILDQDGKIVNEDLVPDLSDEELVELMTRMVWSRVLDQRSTALNRQGRLGFFAPTAGQEASQLASQFAMEKEDYLLPGYRDVPQLVQHGLPLREAFLWSRGHVAGNYYAEDLNALPPQIIIGAQYIQAAGVALGLKKRGKENVVFTYTGDGGSSQGDFYEAINFAGAYQANGVFIIQNNGFAISTPREKQTAAKTLAQKAVAAGIPGIQVDGMDPLAVYAIAKEARDWSAAGNGPVLIETLTYRYGPHTLSGDDPTRYRSKEMDDEWVQKDPLTRFRKYLTDKGLWSEAKEEEIIEKTKEEIKVAIAEADKAPKQKVSDFLKNMFEVQPQTIKEQIAFYEAKESK

SEQ ID NO: 6261 - protein, 595 aa, Zea mays
  unsure (1)..(595): unsure at all Xaa locations
MAMGKLEERTRAFWTNRWLVFVGAMWMQSMAGTTYIFGAISPVVKARLGYDQPQVAALGVAKNVGGCLGLLAGALSATWPPWALLAIGAAQNFLGYGWLWLVVSGNAPALPLWLMCVVIFIGTNGQTYFITASLVTSIQNFPKSRGPTVGILKGFMGLTSAILTQVYTVMHTPDHAALIFMVAVGPSLVAIXLMFVIRPVGGHRQIRPSDKNSFMFIYTVCLLLASYLVGAMLVQDFLQPSYDVVVFLTVILFVLLISPIAIPVIVSFMPEKAQHLMEDALLSEPLTGEASSSRQKEDQPEVILSEVEEEKSKETDSLPPSERRKRIAELQAKLVEAAARGGVRIKRRPHRGDNFTLMQALVKADFWLIWLSLLLGSGSGLTVIDNLGQMSQAIGYKNAHIFVSLVSIWNFLGRVGGGYFSEIIVRERTYPRHIALAVAQIVMAAGHFLFAMAWPGTMYIASLLVGLGYGAHWAIVPAAVSELFGVKHFGAMYNFLILANPAGSLIFSELIVSNLYEHEAEKQASQHQMSALLSPRLLRDTGFLADDALKCEGPACFFFSSLIMSVFCAVAAGLSLLVVQRTRQVYPRLYSSVRT

SEQ ID NO: 6262 - protein, 408 aa, Glycine max
MVAMAAATASTQLIFSKPCSPSRLCPFQLCVFDTKQVLSSGRRRHVGGSGVRCMAVGEAATTGTKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 6263 - protein, 505 aa, Staphylococcus aureus subsp. aureus MW2
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 6264 - protein, 374 aa, Solanum melongena
LQEFDPDQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLENSTFDDELKLWHIIINKVKLNVSPGCSFHCSEPGWFRVCFAA

SEQ ID NO: 6265 - protein, 306 aa, Rhodobacter sphaeroides
MAQTSLTPRASAELLLLGTIWGGSFLANGLALPQAGVAGTVAVRVGGAALVLWVAVRLLGLAVPRSLRIWASFLVMGLLNNVIPFTLITWGQQSIPSGLASILNAATAIFGVLVASLVLADERLTPRRIAGVLLGFAGVVTTIGPDALTGFDPRSAGQLALLGAALSYACAGAFGRRALAGLDPRMAAAGMLTGASLIVLPAALLLGGPPRLDLSLQAWGALFYLAVVASAFAYLLYYRILAVAGAGNLSLVTLIVPPVAILLGALVLGERLPPHAFAGFGLLVAGLLVLDGRILHIPRELVRRAR

SEQ ID NO: 6266 - protein, 348 aa, Catharanthus roseus
MELQSSEIRNAQAHFFTQVFSFTSMSSLKCAVQLGIPDAIHSHGKPMALSDLTNSLPINPSKAPYIYRLMRILVAAGYFSEEEKNVYSLTPFTRLLLKNDPLNSISMVLGVNQIAELKAWNAMSEWFQNEDLTAFETAHGKNFWDFGAEDKYGKNFDGVMAADSILVSKMLIPEFNYLFEGLDSLVDVGGGTGTIAKAIAKSFPDLKCTVFDLPHVVANLESTENLEFVGGDMFEKIPSANAILLKWILHDWKDEECVKVLKMCRKAIPEKEKGGKVILIETVLMDSKKHENEEAVKAQISSDIDMMVFFTAKERTEEEWATLFREAGFSGYKIFPMIDFRSPIEVYP

SEQ ID NO: 6267 - protein, 170 aa, Microbulbifer degradans 2-40
MSCAVYAGSLVLTSSDIGDGKHMAKTQEYTGFGCAGGNLSPQLSWRGAPEGTKAFALLVHDPDAPTGSGWWHWQVVNIPAGTTSLPAGAGAVNSKLLPKGASQNTNDYGEKAFGGACPPVGHGVHRYRFTLHALSKPLELPENASAALTGYMVKAHTIEEATIEALYKRD

SEQ ID NO: 6268 - protein, 275 aa, Xylella fastidiosa 9a5c
MIPISFEFYPPKNDDQRAQLDRTANRLRTFTPEYVSCTFGAGGSTLSYTSETVRHLSQHHGFDAAPHLSCVGGSRQEIRELLKLYRAIGCQRIVALRGDLPSGMGHPGDLRYAADLITFIRAEHGDHFHLEIGAYPETHPQASNTLNDLHYFKAKADAGADAAITQYFYNPDAYFHFVDAVQRLGVTIPIVAGVMPISNFDKLHHFSEQCGAEIPRWITKKMQAYGDDTKSIRAFGADVVTALCERLIAGGAPGLHFYTLNLAKPSTQVLQRLGY

SEQ ID NO: 6269 - protein, 416 aa, Methanothermobacter thermautotrophicus str. Delta H [sequence omitted]

SEQ ID NO: 6270 - protein, 246 aa, Petunia x hybrida
MGRGRVELKRIENKINRQVTFAKRRNGLLKKAYELSVLCDAEVALIIFSNRGKLYEFCSSNNMFKSLERYQKCSYGTLEVNQSSKDNEQNNYREYLKLKAKYESLQRYQRHLLGEDLGPLNIDDLENLEVQLDTSLKHIRSTRTQLMLDQLSDLQTKEKLWVEANKVLERKLEEIYAENSLQQSWGGGEQSVTYGHQHNAQSQGFFQPLECNSTLQIGYNPITTSRQITAVTNAQNVNGMVPGWML

SEQ ID NO: 6271 - protein, 371 aa, Eriobotrya japonica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLSIAKSLGADEVVKVSTNIEDLAEEVATIQKVLENGVDVSFDCAGFDKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 6272 - protein, 425 aa, Microbulbifer degradans 2-40
MLDPNSRYVSRLTRDTVALVLAGGRGSRLHELTDWRAKPALHFGGKFRIIDFPLSNCVNSGIRRIGILTQYKAHSLIRHVIRGWSSFKKEFGEYVEILPASQRYSPNWYQGTADAIYQNLDILQAEAPKYILVLSGDHVYQMDYGAIIAHHVETGADLTVSCIEVPIEEAAGSFGVMTVDDDNRIIRFDEKPQRPTELANKPGYTLASMGNYVFNTEFLFDQLRKDAADPDSEHDFGKNIIPNIIAEKLVSAYRFRDHDTNETAYWRDVGTLDSFWEANMELVSPNPSLNLYNHDWPIWTYQTQLPPAKFVFDDDSRRGYAVDSMVSGGCIVSGGKVKSSLLFSDVHIHSYAEIEESVLLPEVEVHRSAKIKKAIIDSACVIPEGMIIGHDHEHDKARGFRVTKKGVTLVTREMLGQQPAGTSAK

SEQ ID NO: 6273 - protein, 777 aa, Hordeum vulgare
MATAARPPFLAMAAAALLVAAWWGGNAGAAEAQAQAPVFACDASNATLAAYGFCNRKATASARARDLVSRLTLAEKVGFLVNKQPALGRLGIPAYEWWSEALHGVSYVGPGTRFSPLVPGATSFPQPILTAASFNASLFRAIGEVVSTEARAMHNVGLAGLTFWSPNINIFRDPRWGRGQETPGEDPLLASKYAVGYVTGLQDAGAGGVTDGALKVAACCKHYTAYDVDNWKGVERYTFDAKVSQQDLDDTFQPPFKSCVLDGNVASVMCSYNKVNGKPTCADKDLLEGVIRGDWKLNGYIVSDCDSVDVLYTQQHYTKTPEEAAAITIKSGVDLNCGNFLAQHTVAAVQAGELSEEDVDRAITNNFIMLMRLGFFDGDPRQLAFGSLGPKDVCTSSNRELARETARQGIVLLKNSGALPLSAKSIKSMAVIGPNANASFTMIGNYEGTPCKYTTPLQGLGAKVNTVYQPGCTNVGCSGNSLQLSTAVAAAASADVTVLVVGADQSIERESLDRTSLLLPGQQTQLVSAVANASSGPVILVVMSGGPFDISFAKASDKIAATLWVGYPGEAGGAALDDTLFGSHNPSGRLPVTWYPASYADTVTMTDMRMRPDTSTGYPGRTYRFYTGDTVFAFGDGLSYTKMSHSLVSAPPSYVSMRLAEDHLCRAEECASVEAAGDHCDDLALDVKLQVRNAGEVAGAHSVLLFSSPPPAHNAPAKHLVGFEKVSLAPGEAGTVAFRVDVCRDLSVVDELGGRKVALGGHTLHDGDLKHTVELRV

SEQ ID NO: 6274 - protein, 300 aa, Zea mays
  unsure (1)..(300): unsure at all Xaa locations
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQVSIXSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNI

SEQ ID NO: 6275 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRSIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 6276 - protein, 530 aa, Blumeria graminis
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFIKKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 6277 - protein, 362 aa, Mycobacterium tuberculosis CDC1551
MSASLPVFPWDTLADAKALAGAHPDGIVDLSVGTPVDPVAPLIQEALAAASAAPDYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 6278 - protein, 397 aa, Halobacterium sp. NRC-1
MASLLALVALVASMFMAFTVGANSNSAPIAPAVGANALSTLRGALLVGIVAGLGAISQGGSISETIGHGLVTGVTITPLAAAATLLTAATLITIGNSRGYPIPSAFTVTGAAVGAGVALGGGFAVGTYLNILGFWFAIPIVEGVLAYALARVLIGDRVPDHVTVPVLAGGVGYALAMIRLSVLPAPQGARATVAGVVARHLPAGVVPTTALGVAGAIAVVLAGAMYWQLRRDVTTGIHRLLVGLALAVLFTSGGSQVGLATGPLEPVFESALDLPAIYLLVLGGVGILVGGWVRSPRLIQAVAREYASLGPKRSIAAFIPAFLTAQAAIMFGYPISFNKVMISSIIGAGLVGGAADTGGVSVTKTGYTVAAWVGSMVGGAVLSFGLYRLLAAIPGLQ

SEQ ID NO: 6279 - protein, 515 aa, Geobacter metallireducens
MPYLREKADMAWTDPTKGTLPSMTAMKHSIIRKDLILLSQSVLYWTIGKKISVWSTCMKSYARFFPDLALNVRDKTPIATREVSEDWHDSKLKTTAFLPIDLVLCYKFAYPFYSEVVTMPIATKIAGHISKSSWIRKMFEEGERLRQVHGAENVYDFTLGNPDTEPPREFQEEFARLATNPIPGMHRYMNNAGYQETRAAVAEVLAEASGLPVEAGHVVMTCGAGGALNVVLKTILNPGEEVIILTPYFVEYKFYIDNHGGVPKEVWTNRETFQLNIPAIEAAITNKTRAVIICSPNNPTGVIYPEESLKELGEMLARAERRYDRQIYVISDEPYARIAFDGKHVPNIFRYVESSVIVTSHSKDLALPGERIGYLAVNPSARGVEQFVEGAVFSNRVLGYVNAPALMQRLVTKLQRASVDIGEYQSKRDLLYDRLTAMGFEMVRPDGAFYLFPKSPLTDDVEFVKMAQKHRILLVPGAGFGAPGFFRIAYCVDRGMIERSLPAWQQLARETGLGG

SEQ ID NO: 6280 - protein, 463 aa, Pseudomonas fluorescens PfO-1
MAFGELRNSDQFVVHLRVAVLVQAQFDDALDRQAELGHVDFGRVAGDDAAGLEFGHALGDGGGGEVHFAGEVGVGRATVFEQGAEQHAVVFVQGRTPEMPDFRNRGLSRRSPCFQKCTGAINRFCNLFLAVGLSRITHPLSLTFELPMSALRRFSLPLIAAFFALYVIWGSTYLVIRIGVEYWPPLMLGGVRFVIAGTLMYAFLRWRGAPAPTWAQWKAAGIIGILLLSFGNGAVTLAEHSGVASGVAALAVATVPLFTLLCGYLWGTRNTRLEWAGVVMGIIGIAMLNMGSNLQSSPLGAALLIFAAASWAFGSVWSKHLPLPQGAMASAVEMLVGGAVLLIGSAASGEHLQAMPPLEGWLALAYLIFFGSIIAFNAYMYLLKNVRPAAATSYAYVNPAVAVLLGIVFVGETIGIEEALAMLVIIGAVVLISLPQWRRPARPPVVSEPAAAAKVIATEQRAN

SEQ ID NO: 6281 - protein, 181 aa, Zea mays
  unsure (1)..(181): unsure at all Xaa locations
MASSMLSSATMVASPAQATMVAPFNGLKSSAAFPATRKANNDITSITSNGGXRVNCMQVWPPIGKKKFETLSYLPDLTDSELAKEVDYLIRNKWIPCVEFELEHGFVYREHGNSPGYCDGRYWTMWKLPLFGCTDSAQVLKEVEECKKEYPNAFIRIIGFDNTRQVQCISFIAYKPPSFTG

SEQ ID NO: 6282 - protein, 458 aa, Oryza sativa (japonica cultivar-group); identical to SEQ ID NO: 4224

SEQ ID NO: 6283 - protein, 521 aa, ASPERGILLUS NIDULANS FGSC A4
MTDRFARTDGSTTHSCNLTEGLYCGGTWRGTIDHLDYIQGMGFDAVLISPIIKNVEKKAKYGEAYHGYWAQDMYSLNPHFGTHEDLLDLSQALHNRGMFIMMDTVINNMAYTMNGGNPATDVNYTSLNPFNEKSFYHPYCKIDDWNDYPQSQYCWTGDNIVALPDLNTEDERVQTILEMWIQEMIATYSIDGLRIDAAKHVTPDFIGKFEKAADVFMFGEVYERSVDIICGYQSNIMPSVTNYPIYFALLDAFTIGDTESLPNQVESMKSKCPSVTSLTIFSENHDLPRFASLKDDINLAKNILTFTLLFDGLPIIYQGQEQHFSGSTDPHNREALWPSAYDTSSPLYNTIHTLNTIRKHAIQIDPDYYINYNTYPVYRGSSEMAFRKGREGRQIIMVLSTQGSNSGAYTIRMMNGFQPSVVARDVFSCRTWTVNDMGELRLDMDKGEPRVLFPEALMRGSGLCGYAREKVTYMDFVNKTYSPESGDDKESGGVVGSSVVVGGTGVALVWALLGLISFAMC

SEQ ID NO: 6284 - protein, 498 aa, Oryza sativa (japonica cultivar-group)
MAAAAVAADQKVVTMTSLREGCACAAPPAAAAPPMPKMAAAQRVVAELREACATPAARLAEVAAAMAGEMEAGLAVEGGSSEMKMIVSYVDSLPTGGEEGSYYALDLGGTNFRVLRVRLAGGGVAERVAREVPIPPGLMSGGGATSECLFGFIASALAEFVGEEEEEGGLDGGERELGFTFSFPVHQTSIASGTLIRWTKAFAVDDAIGEDVVAALQAAMSERGLDMRVSALINDTVGTLAAGSYYDEDVVAAVILGTGTNAAYVEDATAIAKLHPSQLPASNTMVINTEWGSFASPCLPLTEFDEALDQESLNPGEQTYEKLISGMYLGEIVRRVLLKISSRCPSLLGGAGELATPFVLRTPDVSAMHHDETPDLSIVGEKLERTLGIRGTSPEARRMVVEVCDIVATRAARLAAAGIVGILKKIGRVDGGEGRRRRSVVAVDGGLFEHYGKFRRCMESAVRELLGEAAAERVVVKLASDGSGLGAALVAAAHSQRA

SEQ ID NO: 6285 - protein, 368 aa, Agrobacterium tumefaciens str. C58
MSAELNQPVPRPGILDIAAYVPGKEHVDGVAKVYKLSSNETPLGPSPKAIEAFSAAASHLEIYPDGQAIALRQAIADVHGLNIANILCGNGSDELLGLLCHVYLGAGDEAIITEHGFLVYKIQIMGAGATPVTVKEKDCVVDVDAILAAVTPKTKMVFLANPGNPTGTYVPVAEIRRLQAGLPKHVVLVLDAAYAEYVRKNDYEAGLELVSGNRNVVMTRTFSKVYGLAALRVGWMYAPVDIIDALNRVRGPFNMSAPAIAAGAAAIRDQAFVQKAVAHNALWMEKLVTTFTGLGLTVTPSVANFILIHFPDQDGKRATDADEFLSRRGYILRAVRGYGFPNALRMTVGSEEANLGVIAALTEFMGQA

SEQ ID NO: 6286 - protein, 621 aa, GIBBERELLA ZEAE PH-1
MHIKDMLNDAERSGQPSFSFEYFPPKTAQGVQNLYDRMDRMYNLGPKFIDITWGAGGRIAELTCEMVLQAQAVYGLETCMHLTCTDMGVEKVNDALLKAYKAGCTNILALRGDPPRAQDKWEAADGGFQYARDLVKHIRNTYGNHFDIGVAGYPEGSDDNKNEDELLDHLKEKVDMGATFIVTQMFYDADNFIRWVKRVRERGITIPILPGIMPIATYASFLRRANHMQAKIPQEWLDALEPVKNDDVAVRNIGKTLVANMCRKLLANGIHHLHFYTMNLAQATRMLLEELQWAPSADRPLQHALPWKQSKGLGRREEDVRPIFWRNRNKSYVIRTQDWDEFPNGRWGDSRSPAFGELDAYGIGLTGSNEANRKKWGEPKAIQDIAELFVSYLNNKIESLPWSESPLTTEADEIRDDLIELNKRGLLTINSQPAVNGVKSSHPIHGWGPDNGYVYQKSYLELLVHPGVFDKMISRIENHPDLTYYAVTKDGELRSNVTSDGPNAVTWGVFPGKEIVQPTIVESISFLAWKDEAFRLGVDWAHCYDISSPSRALLEGVMNDWYLVNIVNNDFHDNKTIFELLKGLEVNDLTTPATPLSEPVANGAVDTEPIANGTAVTAAAN

SEQ ID NO: 6287 - protein, 192 aa, Oryza sativa
MGGGKDKHDESDKGLFSNMMHGVAGGHGYPPHQGYPPQGYPPPPGAYPPPPGAYPPPPGAYPPPPGAYPPQHGYPQPGGYPPPGGYPQHGGYPPAGYPGSSGHQGGHGSSGGGHMGAMLAGGAAAAAAAYGAHKISSHGHGGHMGYGGHGGFGGYGHGYGGHHGGKFKHDKQGQHGKFEDGKRGDGLFGRSV

SEQ ID NO: 6288 - protein, 416 aa, Xanthomonas campestris pv. campestris str. ATCC 33913
MISYAEALAIVQQQVAPLAGEWVSSTEAEGRILAQHVSSPDALPPFDNSAMDGVALATAGNGARAGSDYVIAGTVAAGEVPATADGAAWEIMTGAALPAGADAVVPIEQLEILAQHADRPSLIRLRADVRAGQHIRRRGEDVAVHDRVIEAGTLLRGAHAMVLAALGCARVPVMRQPCVALIATGRELVADPEQRLLPGQIRDGTSHYLLSQLRAAGARVVWQAQVGDDPVAFDAALAQARQAGADVILSTGAVSRGRYDFVPDALARHNAQCLFHKVAVRPGKPVLLARLPDGVLYVGLPGNPMASAAGLRFFVEPALRGLLGMPHEHGLPVSLHAPLPARPVWRQHLRAQLTCSATGMLSVQVLPQQESFRVAPLLQANVWAVVEPQPDGAAPSTVAQVYGLGHLQPAAPVLVP

SEQ ID NO: 6289 - protein, 361 aa, Xanthomonas campestris pv. campestris str. ATCC 33913
MSVSFASTRSPSPRSADELSVILAAPGFGLHFTDHMVAISWTNELGWHDAQVRAYGPLQLDPAASVLHYGQEIFEGIKAYRHADGSIWTFRPQANGERLQRSARRLALPELPVDLFVESLRQLVAVDAGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVVERKVSIDEWKDGVASGEISEVFACGTAAVVTPIGELKGDGFAVGDLSAPAGEVTMSLRQELTDIQYGRVPDRHGWLVRLS

SEQ ID NO: 6290 - protein, 350 aa, Pseudomonas syringae pv. tomato str. DC3000
MSKFWSPFVSGLVPYVPGEQPKLTRLVKLNTNENPYGPSPKAVEAMRAALTDDLRLYPDPNSDLLKHAVAGYYNVQPNQVFLGNGSDEVLAHIFHALFQHDAPLLFPDISYSFYPVYCGLYGIDYEMVALDEQFQIRAEDYARPNAGIIFPNPNAPTGCLLGLDAVEQIIKASPDSVVVVDEAYIDFGGETAITLVDRYPNLLVTQTLSKSRSLAGLRVGLAVGHPDLIEALERVKNSFNSYPLDRMANVGGAAAFEDREHFETTRNKVIESREALVEQLRGKGFDVLPSAANFIFARHPQHDAAALAAKLREQGVIVRHFKQQRIAQFLRISIGTPEQHQALLEGLSDI

SEQ ID NO: 6291 - protein, 585 aa, Synechocystis sp. PCC 6803
MSALSTKLEPTNSYSESLPPQRRSPLEAEGRYRWNRGNYSITRRRIDIWGFVLTLLYQFWLNGKKWSYAGGYTEEKLQQRRRRQAKWIRENLLSLGPTFIKVGQLFSTRSDLFPAEYVEELSKLQDEVPAFSYEQAAGIIEEELGKPIAKLYRSFDPVPLAAASLGQVHKAQLHTGEDVVVKVQRPGLKKLFTIDLAILKKIAQYFQNHPKWGRGRDWNGIYEECCKILWQETDYLREGRSADTFRRNFRGEDWVKVPRVYWRYTSTQILTLEYLPGIKISHYDALEAAGLERKELAQLGARAYLFQLLNHGFFHADPHPGNLAVSPEAGELIFYDFGMMGEITPDTKNKLMDTLFGVAEKNAERIVNSLVALGALKETEDMGPIRRSVQFLLDNFMDKPFEEQSITKISDDLYEIAYDQPFRFPATFTFVMRAFSTLEGVGKGLDPDFNFMAVAQPFALQIMNNSNGFNPAGNIMDELGRQAVQVGNSALGLPRRIEDSLDRLDRGDIRVRVRSTETDRLLRRMGTMQMGTNYVLFTCALVLSATLLFVNNYFMAAAVVLLMSLVPAFALWRLLKRLERQDRMF

SEQ ID NO: 6292 - protein, 465 aa, Gelidium elegans
AKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGDDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 6293 - protein, 498 aa, Hypericum androsaemum
MEFLLITQCSLLFVATYLLVNHVILRGRSKNNGSTKLPPGPRPLPIIGNLLALRDKPHKSLAKLARVHGPLVTLKLGQVTTVVVSSPATAREILQKHDATLSNRYIIDAIRAQGHHEAGLAWVPVGPTWRKFRKVCYSHIFTNQKLNSSQHVRQRTIQQLLAEARESCRVGEAMDVGKAAFRAALSSLSISVMSLDLADAASDTAREFKELARCIMNDVGEPNLADYFPVLKRFDPQGVRGRVEISFGRILDLFGSIIADRMEKRGADEDILDTLLTTHDENPELVEINDIKHLLLDLFVAGTETTSSTLEWAMAELLHKPTTMAKAKAELEQIIGKGNSIDQESEVSRLPYLQAVIQETLRLHPAVPLLLPRRAGEEVHVSGFTIPKDAQVLVNVWAMGRDPEVWEDPCSFTPERFLGSSIDVIGTCFELIPFGAGRRICPGLPLAMRMLQMMLGNLLLSFDWKLPDGVTPECMDMEDRFGITLQKAQPLLAIPLSL

SEQ ID NO: 6294 - protein, 488 aa, Chordaria sp. Kamchatka_4
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGIVVERERLDKFGRPLLGATVKPKLGLSGKNYGRVVYEGLTGGLDFLKDDENINSQPFMRWKERFLYCMEGVNRAAAATGEIKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCGPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 6295 - protein, 180 aa, Agrobacterium tumefaciens str. C58
MTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 6296 - protein, 284 aa, Pseudomonas fluorescens PfO-1
MNDQETFMIRKCLFPAAGYGTRFLPATKAMPKEMLPIVNKPLIEYAVEEARDAGLQHMAIVTGRGKRALEDHFDISYELEHQIRGTEKEKFLAGTRELIDTCTFSYTRQVEMKGLGHAILSGRPLIGDEPFAVVLADDLCLNLEGDGVLTQMIELYKKFRCSIVAIQEVPRDQTHKYGVIAGEAISEGIYRVNHMVEKPAPQDAPSNLAIIGRYILTPDIFDLIADTEPGKGGEIQITDALMKQAQNGCVLAYKFKGLRFDCGDAEGYLQATNFCYENVYLKGR

SEQ ID NO: 6297 - protein, 573 aa, Oceanobacillus iheyensis HTE831
MFEDRAGKVLVDLLSEWGVDHIYGMPGDSINQLMEELRKEKDKMKFIQVRHEEAGALAAASYAKLTGKLGVCLSIAGPGAIHLLNGLYDAKKDSAPVLVLAGQVPTDQIGTDAFQEINMQRMFEDVAVFNEQVVSEEQLPALVNQAVRTAYAEKGPAVLTIPDDIPAAKIKKHVQKNAAIYEEPEQVPSSTEMEKALELIGNAKKPIILAGTGTKGAKQELEQFSDKIAAPVIVSLPAKGVIDDDHPNCLGNLGMIGTKPAYEAMEDSDLVILIGTSFPYVEFLPEGVSYIQIDNDPLKIGKRYPVNVGIAGDSQKSLTRLNERITRTENRDFLENSQEKMAKWWKEMEEDEQQTSTPIKPQQIIAEVQKIAEDDAVLSVDVGNVTVWAARHFRMKTTQKFLTSSWLATMGCGLPGAIASKMAYSDRQAIALCGDGGFSMNMQDFLTAVKYNLPMVVVVFNNERIGMIKYEQEAKGNLDYKTNLESFNFAQFAENCGGKGYRVENFEDLGPSIRAAASFNKPVIVDVCIEDEPPIPGKLSYEQVTSYSKQTIKKLFEKGKLEVPPIRKGLKRM

SEQ ID NO: 6298 - protein, 432 aa, Nostoc sp. PCC 7120
MEIPITLLLVALLAFYVAWNLGANDVANAMGTSVGSKAITLKQAIIIAGVLEFTGAVLFGHGVTETLSTKVANPTLFAATPQVLVTGMMTVLISCGLWLQIATSRGLPVSSSHAVVGAIAGFSWVALGVNAIDWSSIGLITIGWIFTPVISGAIAAFFYSQIKHWILEQPNQVSQLKEWIPWLSAVLLGVFGVIVLPSLTQPLTNVFINQFGVNIPPHDIPLITGAFAAVTLTLITWRQLEEAGEKIPSQPSTVNRQPSTVNNPIESIFARFQVLSACFVAFAHGSNDVGNAIAPLAAIVYINQTGQVPSDGITVPLWILVLGGVGIVGGLAVWGEKVIATIGENIIALQPSSGFCAELATATTILLASRMGLPVSTSHALVGGVVGIGLVQSLDSVKFQTLQGIATAWLVTVPVSAVLSAAIFSIARIFFF

SEQ ID NO: 6299 - protein, 434 aa, Zea mays
  unsure (1)..(434): unsure at all Xaa locations
MEAQNGYSPLLAVDDHEAAAAAAIHATGAGDEGDDVKLRLLGYKQQLKRDLSFNGVGQWAVTTIVDYSLAQLIQVIILLATGGKNGGGYLASKYMVIGFHAXILLIHAVINSLPITFLSFFGQFAAAWNMLCVFVLMVAVPTVATSRPAGIVFTHXNNISNAAASSVLMSPDAVEXQTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPVYSLGSLVAFQAMVSIATIGLYISYALPILFRVTLARKYFVPGPFNLGRYGVLVGWVAVLWVATITVLFSLPVTYPVTKDTLNYTPVAVGGLLFLVLASWLLSARHWFKGPVTNLDG

SEQ ID NO: 6300 - protein, 234 aa, Nicotiana tabacum
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 6301 - protein, 68 aa, Glycine max
  unsure (1)..(68): unsure at all Xaa locations
FRPCKYRTRDDVXKVRHDQDPIEQGRNRLLTAKASEDDLKAIDAQVRDIVNAPADFAQHDPEWDAGEL

SEQ ID NO: 6302 - protein, 164 aa, Zea mays; identical to SEQ ID NO: 4781

SEQ ID NO: 6303 - protein, 341 aa, Chlamydophila caviae GPIC
MPNSSHYNIASKESDEATIKNIVDIYGVSRCLEFIKNMLLIREFETRGEEAYLEGLVGGFYHSYSGQEAVATATLANTGLDQWFFSSYRCHALAILLNIPLRSLAAELLGRETGCALGRGGSMHMCGPNFPGGFGIVGGQIPLAAGAAFAMKYRGEDKIALGFIGDGAVAQGVFHETLNFASLHSLPLMLVIENNGWGMGTALNRAIAKQPIGESQGSSYNIRSFTLNGFDLFNCLLGFKEAYEYMQKTRLPVIVECLCSRFRGHSISDPNLYRSKEEMQCLIKKDPIIFAKNWLIQLGVLSEEKFQELRQECRSEVLKAFTEAKSDPEPAIATLEEGVYA

SEQ ID NO: 6304 - protein, 334 aa, Pseudomonas aeruginosa UCBPP-PA14
MTIRLAINGFGRIGRNVLRALYTGHYREQLQVVAINDLGDAAVNAHLFQYDSVHGRFPGEVEHDAESLRVMGDRIAVSAIRNPAELPWKSLGVDIVLECTGLFTSRDKAAAHLQAGAGKVLISAPGKDVDATVVYGVNHEVLRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASEGSPVLGYNTQPLVSVDFNHDPRSSIFDANHTKVSGRLVKAMAWYDNEWGFSNRMLDSALALAAARD

SEQ ID NO: 6305 - protein, 100 aa, Zea mays
  unsure (1)..(100): unsure at all Xaa locations
KIKDWSNVVVAYXPVWAIGTGKVAPPAQVQEVXPPLRDWLKTNASPEVAEFTRIIYGGSVTAANCKELAAQPDVDGFFVGGASLKPEFIDIINAAPVKSA

SEQ ID NO: 6306 - protein, 625 aa, Thermosynechococcus elongatus BP-1
MTKANAGHPPSRLLMLGALGVVYGDLGTSPLYAFEETFNPLHVLAVTPANIYGILSLILWGLVLIPTLKYATFALRADNDGEGGIFPLMALVLSRIRLSSHWRRRVIIFGLVGAAMFYGDSTITPAISVLSAIEGLEVLSPQLGSWTVPLTVVILVGLFWFQHRGTTQVGQVFGPIMFLWFMTLGLLGTIHIFEQPTILNALNPWWGVQLFYSQPAQVFFLLGVVILALTGAEAMYADMGHFGIQPIRLAWYRLVFPALALNYLGQGAFILKHPTATHHLFFQLAPEWSVLPLVILSTLATVIASQAVISGAFSMTAAAIKLGYLPRLRIDVTDDYHRGQIYIPVINWLLLVTVLLLVMTFRKSSELAGAYGLAVNLTMVVTTLCLILVARHLWRWSIVQISLVWVSILVIEIAFLIGNALKIPYGGWYPLAFGGVVYMLLGTWRQGQVLLRQQLLQANARFSLKELLSQGVARVPGIAVFFSPLPDMIPLSFIQNLQHNHVLHQQTIFIHLATANLPHVPLSEQLTYRVTDVGIYEIILTSGFRDRPDLRLALETCQQALNLPLNGQPMSFFLGRRTIIPTHARGMTYWQKVVFAWLYRNAEDATSYFRLPSEQVVELGIQVEI

SEQ ID NO: 6307 - protein, 467 aa, Rhodobacter sphaeroides
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGAAVKAEAYLKASGIGDVAYFGPEAEFFIFDDVRYSVTPAKVAYQIDADAGAWNTDSEYEMGNLAHRAGHKGGYFPVNPIDEAQDLRGEMLSTMKRMGMKVDKHHHEVATCQHELGLIFGGLTEQADNILKYKYVIHNVAGMHGKTVTFMPKPMKGDNGSGMHVNMSIWKEQALFAGDKYADLSQEALWFIGGILKQPSVNALTNPATNSYKRLIPGFEAPVLRAYSARNRSGCVRIPWTESPNAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 6308 - protein, 390 aa, Oryza sativa
  unsure (1)..(390): unsure at all Xaa locations
FFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSTGFRHTYPAPSYAQNPAASLAPQADYTWRLILMFGTIPAGLTYYWRMKMPETARYTALVARNAKQAAANMSKVLHAEIEERPEVVESQVVAGETWGLFSRQFMKRHGMHLLATTSTWFLLDIAFCNQNLFQKDIFSKIGWIPPAKTMNALEELYRISRAQALIALCGTIPGYWFTVAFIDIVGRFXIQIMGFFMMTVFMLALGVPYDHWTHPAHHTGFVVLYALTFFFANLGPN

SEQ ID NO: 6309 - protein, 188 aa, Zea mays
  unsure (1)..(188): unsure at all Xaa locations
MSSDGEKVPKRAESPVADSENDGGNTDGLHRRLNNRQVQLLSIGGTVGTGLFIGIGXGLAKSGPGSLLVCTALYAMVLGLTNNSIAEMNTYMPXSGGFIRLAGHWVDDALGFMVGWNFFLYEALLIPFEIVAXNLVVSFWSDNVTQAGPTAGFIIAGIIAYGVLNLLAVGVFGEAEFWLALGKALLIF

SEQ ID NO: 6310 - protein, 345 aa, Ralstonia eutropha
MALISLRQLLDHAGEFGYDVPAFNVNNLEQIHAIMEAAQETDSPVILQASAGARKYAGEAYLRHMVLAAAETHPDIPIVLHQDHGSSPAICQASIRSGFTSVMMDGSLREDMKTPSDYDYNVEVTRRVCEMAHAIGVSVEGELGCLGSLETGQAGEEDGVGAAGTLSHDMMLTDPAQARDFVARTGVDALAIAIGTSHGAYKFSRKPTGDILAMDRIREIHEQIPDTHLVMHGSSSVPQEWLEIIRQYGGDIKETYGVPVEEILRGIKMGVRKVNIDTDIRLAMTGAIRKSLSDDRSEFDPRKALLAAKKGARSVVKLRFEAFGCAGQASRIKPVPLERVAKLYS

SEQ ID NO: 6311 - protein, 114 aa, Klebsiella pneumoniae
SLYDIAPVTPGVAVDLSHIPTDVKIKGFSGEDATPALEGADIVLISAGVARKPGMDRSDLFNVNAGIVKNLVQQIAKTCPQACIGIITNPVNTTVAIAAEVLKKADVYDKNKLF

SEQ ID NO: 6312 - protein, 338 aa, Enterococcus faecalis V583
MYKAIVAAKGKTTKIVEKESRPLKDNEARLKMEVCGVCHTDLHVKNADFGDVSGCTLGHEGIGIVTEVGKDVTSLKIGDRASVAWFYEGCGHCEYCTSGRETLCRSVKNAGYTVDGAMAEECIVTDGYAVKVPENLASEPASSITCAGVTTYKAIKESGIRPGQWLMISGLGGLGNLALQYAKHVFNAKVVAVDVNDNQLAFAKEMGADLLINPVKDPDFAAQLQKEIGGVHAAVVTAVAKSAFNGAVDAVRAGGTVVAVGLPVETMDLSIPRLVLDGIHVVGSLVGTRQDLREAFQFGAEGKVVPVCQTRQPEEINAIFEEMEQGKIRGRMVIDFRS

SEQ ID NO: 6313 - protein, 660 aa, Rhodospirillum rubrum
MNATMDATAPLRDPGAPSAENCSVDRRELDDVIGESCRWLGERQNQDGHWVFELEADATIPAEYILLNHFLDEIDDAREARIASYLRAIQGKHGGWPLFHDGDFDMSATVKAYYALKLTGDGVDEPHMVRARQAILEHGGAERTNVFTRFTLAMFDQVPWRACPVTPVEALLLPRFAPFHWSKVSYWSRTVMTPLMILYSRRARAVNPRGIGVRELFRRDPEVIRDWLKNPTGHWIGDALIQIDKVLRVIEPAIHWAFRDRAEKWALDFIEERLNGRDGLGGIYPAIANTLMAYHTLGYAKDHPGYRIAREAVDGLCTPHAKGEYVQPCLSPVWDTCLASHAIQEAGQSAGDRAVDQSNAWLRERQVLDVVGDWKSNRGHLRPGGWAFQYNNPHYPDVDDTAVVVMALARSKEDEANREAIARAEEWIIGMQSSNGGWGAFDAENEHDFLNHVPFADHGALLDPPTVDVSARCLGMLAQLGRPKTDPVVARGLDYLWREQEADGSWFGRWGTNYIYGTWSALNAFNAVEWDMTDPRICKAVDWLKSRQRDDGGWGEDCATYWKERRSVSKASTPSQTAWAVLGLMAAGEVDSPEVERGIRYLLEAPRDGGKWEEELYNAVGFPRIFYLRYHGYSAYFPLWALARYRNLTSGNCKRTIHGM

SEQ ID NO: 6314 - protein, 411 aa, Hordeum vulgare
  unsure (1)..(411): unsure at all Xaa locations
LPGLPEGVADLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDETGVSNDLYDFLQVFFKKHPEFIKNDFFITGESYAGHYIPAFASRVHQGNKKNEGTHINLKGFAIGNGLTDPAIXYKAYTDYALEMNLIQKADYERINKFIPPCEFAIKLCGTNGKASCMAAYMVCNTIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLK

SEQ ID NO: 6315 - protein, 282 aa, Escherichia coli
ALLLKTQLPSGSELSLYDIAPVTPGVAVDLSHIPTAVKIKGFSGEDATPALEGANVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 6316 - protein, 453 aa, Bacillus anthracis str. Ames
MYFNNVETKPGIGYPKQWEDQEKYKGGWELKNGEIQLKSGSKMKRLMNIFHNPDQPTIDDYFEPWNYDYETLTTSPQRKHQPVARPKSAITGEFIDKIEWGPNWEDDLAGGHITGLQDPNVKKMEEEIKTDFENVFMMYLPRICEHCMNPSCVSSCPSGAMYKREEDGIVLVDQNACRAWRFCVSSCPYKKVYVNWQTNKAEKCTMCFPRIEAGMPTICSETCVGRIRYIGVMLYDADKVKEAASVENEKDLYESQLTVFLDPNDPEVVAEAKKQGIPEEWIKAAQESPIYKMIIDWKIALPLHPEYRTMPMVWYIPPLSPIMNMVEGKGSNWQAEEIFPAIDNMRIPIQYLANLLTAGDESHIRLTLKKMAVMRTHMRALQINKEPNEAVLKELGLTKQDVEDMYRLLAIAKYKDRFVIPTSHREQVADLYNEQGSCGLSFAGGPGSCMTIS

SEQ ID NO: 6317 - protein, 534 aa, Oryza sativa (japonica cultivar-group)
MAQMLDGLRHDEQASLHAPQEASTMPTMSCSDLLLAMMCPLILLLIIFRCYAYATRSGGMLSRVPSPPGRLPVIGHMHLISSLPHKSLRDLATKHGPDLMLLHLGAVPTLVVSSARTAQAILRTHDRVFASRPYNTIADILLYGATDVAFSPYGDYWRQIKKIVTMNLLTIKKVHSYGQTRQQEVRLVMAKIVEEAATHMAIDLTELLSCYSNNMVCHAVSGKFFREEGRNQLFKELIEINSSLLGGFNLEDYFPSLARLPVVRRLLCAKAYHVKRRWDQLLDQLIDDHASKRRSSMLDNNDEESDFIDVLLSIQQEYGLTKDNIKANLVVMFEAGTDTSYIELEYAMAELIQKPQLMAKLQAEVRGVVPKGQEIVTEEQLGRMPYLKAVIKETLRLHPAAPLLVPHVSMVDCNVEGYTIPSGTRVIVNAWAIARDPSYWENAEEFMPERFLSNTMAGYNGNNFNFLPFGTGRRICPGMNFAIAAIEVMLASLVYRFNWKLPIDQAANGGIDMTETFGITIHLKEKLLLVPHLP

SEQ ID NO: 6318 - protein, 485 aa, Geobacter metallireducens
MGNVRCRHRGRKPRRGHRVQQPDRPGAPGAGRDEPLRCPAENQERRGHLPRSLYSRGGGGLSGRSESHPSHRRHGPVLLTSVGGRFREEVLHRLLQRERVESSGGGHRPDRRTGGAGSPRQVGERETEGGRRGPEMIPLRQNIASMKGYIPGYQPPDIASWIKLNTNENPYPPSPEVVKAILEELGPDGAALRIYPSASSQKLREVAGELYGFDPSWIIMANGSDEVLNNLIRAFAAEGEEIGYVHPSYSYYGTLAEVQGARVRTFGLTGDFRIAGFPERYEGKVFFLTTPNAPLGPSFPLEYIDELARRCAGMLVLDETYAEFAESNALELVRRHENVVVTRTLSKSYSLAGMRIGLAIARPEVIAALDKIRDHYNLDRLAQAACVAALRDQAYLSECCRRIRETREWFTTELRSIGYDVIPSQGNYLFATPPDRDGKRVYDGLYARKVLVRHFSDPLLAHGMRISIGTREEMEQTLAALKEIG

SEQ ID NO: 6319 - protein, 406 aa, Lycopersicon esculentum
KGVKGDEDSNSQEQASSTATGTANPEWPGFQGYSPMPPHGFMASSPQAHPYMWGVQHLITLWYSTTSLCHYVSHGGIYAHPSMPPGSYPFSPFAMPSPNGVAEVAVNTSSNTELDGKSSEVKEKLPIKRLKGSLGSLNMITGKNTELGKTSGASANGVYSKSAESGSEGSSEGSDANSQNESPMKSAGRQDSAEERSQNRNSAHSSQMRTSAPHSLSTKLCNHANVSCGCWRYSWPHNQLEYWYGLLECRSFADIPAIHGKVPSASVAGGIGNAGSRDIVQSQMWIQDERELKRQRRKQSNRESARRSRLRKQAECDELAQRAEVLKEENASLRAELSCLRSEHDQLASQNASLKERLGEVSGRDDPRPSRKYIHLNKDTQTSSQTEPTGVSEVLARLCDEMAYYN

SEQ ID NO: 6320 - protein, 338 aa, Escherichia coli O157:H7 EDL933
  unsure (1)..(338): unsure at all Xaa locations
MQKKSIYVAYTGGTIGMQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAANYPINEVTLFFNNRLYRGNRXTKAHADGFDXFASPNLPPLLEAGIHIXRLNTPPAPHGEGELIVHPITPQPIGVVTIYPGISADVVRNFLRQPVKALILRSYGVGNAPQNKAFLQELQEASDRGIVVVNLTQCMSGKVNMGGYATGNALAHAGVIGGADMTVEATLTKLHYLLSQELDTETIRKAMSQNLRGELTPDD

SEQ ID NO: 6321 - protein, 1474 aa, ASPERGILLUS NIDULANS FGSC A4
MAFLFKSKKNQQTSGLPPATRNVHTSEGAPAGSGATLNGSKDGVVTSQTPTPSGSYNNSLNSVTSTNSPEQQRMRQRAESESQAQRPQQSTSPVSSPGSSLYPWSQRRLNFSSPQANPFPRYGAAINAVASKEGDIYMMGGLIDGSTVKGDLWMLESSSGNLSCFPIATVSEGPGPRVGHASLLVGNAFIVFGGDTKVDENDTLDDTLYLLNTSSRQWSRSIPPGPRPTGRYGHTLNILGSRLYVFGGQVEGYFFNDLVAFDLNQLQNPGNKWEFLIQNSHEGGPPPGQIPPARTNHTIVSFNDKLYLFGGTNGLQWFNDVWSYDPRTNSWTQLDCVGFIPTPREGHAAALVNDVMYVFGGRTDEGIDLGDLAAFRISTRRWYSFQNMGPAPSPRSGHSMTAFGRQIIVLAGEPSSAPRDPVELSMAYMLDTSKIRYPTENPNGEKAMFPGPTKTGAGEKPPSGRVSREAQNQPSDQFRRAQGPRESVVSPTGRPTELGPGPGSRLPRASIANAPAGPPPPGQAPTPGPRGNPPRDGNNFRSKTPTKQERGYGGPPIDTTRAIAGDREREPAPRDSPKDPRFAQESTGQRTPTQQSQRMSARAMEAGEAAPLVAPARQRSLRQRQRSSMDSADESILGRHASIDGSVDSRTHRNSRTGDEPRSPRLTAHQEALFKELEALKSRNAWYASELALAKKAGYTPNISANSALDERTSDAFTDEDRPLIEAFLAMRAELAKMQATVDRQAAIASKRVAEVEQQRDVAVNEAAYARAKLAAHGGSQQSTPSLDGQSHDLDKAASDRTTDLSRRLALALASQNELKSKLEALSTDLEQEKRGRELAEETSEATRRRLAELEMQNNPLETESLRAQLHQVEASFREESMLRSEAESSLKQLALDKEELSRKLEDSTNRLRDFGDNIGGLKQAVTASVEKASILEKKLDEERERREGLERKLLQLRSEHEERTAELENATRRLRDAEELAESHAREAEAHKNAFILGLERASSFDSETSIRSLVDQRVATSEAQVERANKLARASQAAADEAAEKLRRAEERIAGLEAYQEQASREGLQLRRQLQAALKDCQTYTAENRELKAQIENHQREAGALAVQHAALKDLLGERGYTDSRRSPRGESPGSRFGTPEQNRLRELEQQLSASLKAHDELKASFETREQETDRAYKEKLEQLENDYQSAVHYVKGTEKMLKRMKDELTRYKMQNAKIQSELEAAQSREGSVAPSGWEAERSQLQQSLTDLQQDTSRSITNLEEQITSLKESLASAEAEKEKSVAEYETMRQELLAVSEKTSSELEQLKHENSLLEARAMDAEQKVSMLLDQVEASVGHYRRQSQHGQGVNGISRTHSNASSGTIGAGTRRSRANSAVSQDDTFLDNRGSMALDSLANELEALRSHWESTNSNYRLSTQSDFDRTPTKDSGLSDSLAEWRRRLDEEEARAGSPEKGKPRTAAEGQAAANMI

SEQ ID NO: 6322 - protein, 512 aa, Pseudomonas fluorescens
  unsure (1)..(512): unsure at all Xaa locations
MKIRSQIGMVLNLDKCIGCHTCSITCKNVWTSREGMEYAWFNNVESKPGIGYPKEWENQDKWKGGWVRNADGSINPRIGGKFRVLANIFANPDLPSLDDYYEPFDFDYQHLHTAPLGEHQPTGRPRSVVSGKRMEKIEWGPNWEEILGSEFAKRRKDKNFDKIQADIYGEYENTIMMDLPRLCEHCLNPACAASCPSGAIYKREEDGIVLIDQEKCRGWRMCISGCPYKKIYFNWKSGKSEKCIFCYPRIEAGMPTVCAETCVGRIRYLGVLLYDADRISEVASTANEQDLYEKQLEIFLDPNDPAVIRQALADGVPQSVIDSAQRSPVYKMAVDWKLALPLHPEYRTLPMVWYVPPLSPIQNAATAGTVGMNGVIPDVDSLRIPLRYLANMLTAGDEKPVKLALKRLLAMRAYKRAEQVDGVQDLQVLADVGLSVNQVEEMYRYLAXANYEDRFVVPSAHREDAMSDAFAERSGCGFSFGSGCSGSSDTNMFGGKKANRRDVIKTVQLWEE

SEQ ID NO: 6323 - protein, 497 aa, Pseudomonas syringae pv. syringae B728a
MTTLTRADWEQRARNLKIEGRAFIQGEYTAASSGETFDCISPVDGRMLAKVASCDAADAQRAVDSARSAFNSGVWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAASAAASAIAFNQGEVCTAGSRLLVERSIKDRFLPMVIEALSAWKPGNPLDPATTVGALVDTQQMNTVLSYIEAGHSDGAKLVAGGKRILQETGGTYVEPTIFDGVNNAMKIAQEEIFGPVLSVLTFDTAEEAIQIANDTQYGLAAAVWTANISKAHLTAKALRAGSVWVNQYDGGDMTAPFGGFKQSGNGRDKSLHAFDKYTELKSTWIKL

SEQ ID NO: 6324 - protein, 468 aa, Oryza sativa
MATAGALALVAICSYLAVTSNKQKRRRRPPVVGTVFHQLYNVRRIHDYHTALSREHTTFRMLVPAGGDQIYTCDPAVVEHILKTNFANYGKRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 6325 - protein, 189 aa, Thermococcus celer
MSNVKLRIENIVASVDLFTQLNLERVIEMCPHSKYNPEEFPGIICRFDEPKVALLIFSSGKLVVTGAKSVEDIERAVNKLIQMLKKIGAKFSRAPQIDIQNMVFSGDIGMEFNLDAVALSLPNCEYEPEQFPGVIYRVKEPRAVILLFSSGKIVCSGAKSEHDAWEAVRKLLRELEKYDLIGEGEEEEW

SEQ ID NO: 6326 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 6327 - protein, 303 aa, Triticum aestivum
  unsure (1)..(303): unsure at all Xaa locations
APPGPPSSPPTTPRRSPPPPGTPSTPTRTTTAAWSSGGARRGPPPSRPPPPRRPGPTSGTPSSPAAAQRNPASRPPPPRPRRAGAGYRNDFRDSGGVEAQSVQELEGYAXYKAEETTRXVDGCLRVAEEMRDTASKTLLQVHQQGQQIRRTHAMAIDIDQDLSRGEKLLGDLGGLFSKKWKPKKNGAIRGPMLTRDDSFIRKGSHMEQRHKLGLSDRPRRSNARQFLSEPTSELEKVEVEKAKQDDGLSDLSDILTELKGMAIDMGTEIEGQTKDLGHAEKDFDELNYRVKGANTRTRRLLGR

SEQ ID NO: 6328 - protein, 585 aa, Trichodesmium erythraeum IMS101
MSVLLDDIINHNKQANYTTGGSMTKGSSKPYSQKAYRWNRESYSRQRRYIDIWSFVLLWLTWLWVDKKDWSYRGGVTEEKKNLRRRKQAIWVRETMLELGPTFIKLGQLFSTRADLFPSEYVEELSKLQDKVPAFNYEQIETIIEEDLGKKVEELYSSFDPVPLAAASLGQVHRAQLHSGEDVVVKVQRPGLKKLFQIDLAILKGIARYFQSHPQWGRGRDWLGIYEECCRILWLEIDYLNEGRNADTFRRNFRSCNWVRVPRVYWRYSAPRVLTLEYIPGIKISNYEALEASGQDRKALARMGAEAYLQQLLNDGFFHADPHPGNIAVSPEGGLIFYDFGMMGQIKSNIREKLMETLYGIASKDAERVIISLTDLGALKPTGDMGPVRRSIQYMLDNFMDKPFEAQSITAISDDLYEVAYDQPFRFPATFTFVMRAFSTLEGVGKGLDPDFSFMEVAQPFAMQLMSDEDSQKTIFNELGRQAAQVSSTALGLPGRIEDAIDKLEQGDIKVRVRAVETDRLVRRVSNVQMGTNYALLISGFTLSATILYVNNQGGLALVLVLLVVVMGFAFIRLLKRIDRLDKMM

SEQ ID NO: 6329 - protein, 310 aa, Aquifex aeolicus VF5
MPLVSGKVLFEKANEYNFAIGAFNFNNMEFLKAILDAAEEEQAPVFIQTTESAIKYAGIEYLAGMVHAVKDKYSIPFALHLDHGKHVETILLAIRHGYTSVMIDYSDKSYEENLKVTKYVVSICAALGISVEAELGKLVSVEDEVVSREEVLVDPEQAKEFVDRTGIDALAPAIGTAHGAFKFKGEPKLDFERLKKVKELTGIALVLHGASGVYEEYVEKINKYGGDIKGAKGVPDEELKKAVELGINKVNTDTDLRLAFISKLRELMALEKKVIDPRKFLKPAMEEVKNIVKKRIRLYGSQGKAELFRV

SEQ ID NO: 6330 - protein, 243 aa, Glycine max
  unsure (1)..(243): unsure at all Xaa locations
QVDTSVLGLPPHEAKRSPYIASMGVYVFKTDVLLKLLKWRYPTSNDFGSEIIPAAVRENNVQAYFFXDYWEDIGTIKSFYDANLALTEENPMFKFYDPKTPIYTSPRFLPPTKIDKCRIVDAIISHGCFLRECTVQHSXIVGERSRLDYGVELQDTVMMGADYYQTESEIASLLAEGKVPIGIGRNTKIRNCIIDKNAKIGKDVIIMNKDGVQEADRPEDGFYIRSGITVILEKATIEDGTVI

SEQ ID NO: 6331 - protein, 243 aa, Antirrhinum majus
MGRGRVELKRIENKINRQVTFAKRRNGLLKKAYELSVLCDAEVALIIFSNRGKLYEFCSNSGTMLKTLERYQKCNYGAPEANVSTREALELSSQQEYLKLKARYEALQRSQRNLLGEDLGPLNSKELESLERQLDMSLKQIRSTRTQAMLDTLTDLQRKEHALNEANRSLKHRLMEGSQISLQWNPNAHDMGYGRQAAAQPQGDGFFHPLECEPTLQMGFQSEITVGAAGPSVNNYNMTGWLP

SEQ ID NO: 6332 - protein, 292 aa, Pseudomonas aeruginosa PAO1
MRTPAWLGSGMPLLFVLLWSTGFLGAKFGLPYAEPFTFLAIRLLLAAALLAAFALLSGAPWPGSARLAGHVAVAGLLVHGLYLGGVFLAIEHGMSAGLTSLLVGLQPLATAALAGIWLGEQVSRRQWLGLALGLAGVALVVLGRIHGGADGLAWAAVLVALAAITCGTLYQKRFCGGMDLRTGGVVQYLASGALLGLAALLFESREVQWSTPFVLTLGWLVLGLSFGAVGLLYTLIRHGAASKVASLFYLVPPVTALASWLLFDERLAPAAIGGMLLVMLGVALVNWPGRRA

SEQ ID NO: 6333 - protein, 459 aa, Triticum aestivum
  unsure (1)..(459): unsure at all Xaa locations
MATEQPNVLKALEVAMTQLYHSKAVVFAGMGFFTDAYDLFCLALVTNLLGRIYXTAPALNEPGHLPANRSAAANGVARCGTLACQLFFGWLGDELGRKRVFGFTLILMVLCSIASALSLGHEAMGVLGNLCLFGFWLGFGVGXDSPLSATIMSEYANQKTRGTFSAAXLPVQGLGILVGPIVRIVVSSARRHPLAAPLFYIEAAPAIGPAARSVRRLLLLRGPIPPALPFPPRLPLADPARRPAPSGGRPREAAPHRAHVGAHVPFREPGRGDGATGGXWGLSGGQCSKLGGVHLMAPTRRGFPLALAHXRQALFPQQVVPPVGSLPPVQPLQAQDDLPRRARADVPIEPPVAVPGHLRRLREMGVIRWVRIQLRALSLITGPMPGFTIGYEAVIQGGKLAVLVVAAGLIPLSCDFPSSAHRVQRHIRLAGALRRERRRRGGRAGARQDGALCETVLVR

SEQ ID NO: 6334 - protein, 379 aa, Euglena gracilis
MNPFRLLLQRAGGDLMRLKLQSTFKVHTPEGMPEFTGPNDFTEVTVDQIKRFHTDMVRIRRMETKASQMYTQKKIRGFCHLYIGQEAVCVGMESSLTFKDAIITAYRDHAWHLTRGGTITEVIAEMQGKAAGCSKGKGGSMHMYKAANNFYGGNGIVGAQCPVGAGIAFGLAYEDPKAPKGVCLSLYGDGAANQGQLFEAMNMASLWKLPVIFVCENNQFAMGTSVKRGSAQQVFYKRSDYIPGLWVDGMDVLACREGMRYAKEWCMAGNGPVCMEMQTYRYMGHSMSDPGTSYRTRDEVQKVKEERDCISKLSSRLIAEGISTEAELKTVEKETNKEVDKEIAAVEALPPTPFEEIGRDIFDVPITVRACDHTIVYGQ

SEQ ID NO: 6335 - protein, 266 aa, Ralstonia metallidurans
VSLPRPARSQVDAPVPGFVMYPMSAQFAGLEFVGVPLRPDFTLDRAAMLAAMAEHKPAIIYLAYPNNPTGNLFDADDMAAIVRAAQGEVCQSLVVVDEAYQPFAQESWMPRLTEFGNLLVMRTVSKLGLAGIRLGYVAGAPEWLSQLDKVRPPYNVNVLTEATALFALEHVAVLDDQAAKLRAERSKLVEAMAGMPGVTVFPSAANFVLVRVPNAAQIFDRLLARKVLIKNVSKMHTLLANCLRVTVSTPEENAQFLEAFKASLQD

SEQ ID NO: 6336 - protein, 317 aa, Glycine max
  unsure (1)..(317): unsure at all Xaa locations
MGSEVSKQVERRKAIHTEGKTLSDLRNSGEDYPGSDYHPSDRKKWMSELNPEKVVIKQIVWPGTHDSATNKIGIPCITRPFAQCQSLSIYQQLVLGTRVIDIRVQEDRKVCHGVLVTYSIDVVIKDLKXFLSETQSEIIILEVRTEFGHEDPQEFDKYLEEQLGDYLVPQDDKVFEKTIAEVLPKRVICVWKPRKSPQPKAGSPLWSAGYLRDNWINTDLPSTKFESNMKHLSEQQPVTSRKYFYRVENTVTPVADNPVLCVKPVTERIHGFARLFISQCFSKGYADRLQIFSTDFIDQDFVDACVGLTRARVEGRA

SEQ ID NO: 6337 - protein, 764 aa, Methanosarcina acetivorans C2A
MTEEDKSTIKLKVAEADQRDVGKGIVRIDERFREKLGLKPFDVVEIKGGKSTSALIGRPYPSDAGLDIIRMDGLIRTNAKTSIGEYVDIRKADWKEAKSVTFAPVAQGMQIYAPSETLKAVFMNRTVSKGDFISTTSLRRSRERETFGKGVMFEDFFQDFFGQGFGPSFGLGEIKLQVVSTAPAGIVKITDMTQVELLPEAMEIISEQNIPTVMYEDLGGLKDAISKVREMIELPLKHPELFDRLGIDAPKGVLLQGPPGTGKTMLAKAVANESDAYFISINGPEIMSKYYGESERAIREIFEDAEKNAPAIIFLDEIDSIAPKRAEVTGEVERRVVAQLLSLMDGLKARKNVIVIGATNRPEALDIALRRPGRFDREIELRVPDTEGRLEIFQIHTRGMPLADNVNLMDFAQITYGFVGADIAALCREAAMSALRRILPKINLNEPEISKEILDALQVTREDFENALKDVQPSAIREILIEVPNVSWEDVGGLERVKELLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGTSVGEPQVTARILNQLLSEMDGLEELRAVVVIGATNRPDIIDPALLRPGRFDELILVPVPDEGARREIFRVHTKNMALAEDVDIEKLVSFTDQYTGADIAAVCKKAGRHALREDLHAKKVRQKHFLQAIEETGPSVTPDTMKYYEAIKGELRKRKSKEIENPYYV

SEQ ID NO: 6338 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKGYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 6339 - protein, 396 aa, Sesamum indicum
MALKLNAINFQSPKCPSFALPPVASVRSPKFFMASTLRSGSKEVETVKRPFNPPREVHVQVTHSMPPQKIEIFKALEDWADNNILVHLKPVEKCWQPQDFLPDPSSDGFDDQVKELRERAKEIPDDYFVVLVGDMITEEALPTYQTMLKTLDGVWDETGASPTSWAIWTRAWTAEENRHGDLLNKYLYLSGRVDMRQIEKTIQYLIGSGMDPRTENSPYLGFIYTSFQERATFISHGNTARLAREHGDLKLAQICGTIAADEKRHETAYTKIVEKLFEIDPNDTVLAFADMMRKKISMPAHLMYDGRDDNLFDHFSSVAQRLGVYTAKDYADILEHLVARWKVANLTGLSADGRKAQDYVCGLPPRIRRLEERAQGRAKQAPKIPFSWIHDREVQL

SEQ ID NO: 6340 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 6341 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRGNSEDIYAGIEWKADSADAEKVIKFCREEMGVKKIRFPEHCGIGIKPCSEEGTKRLVRATIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 6342 - protein, 275 aa, Escherichia sp. Souza-207
IGQALALLLKTQLPSGSELSLYDIAPVTPGVAVDLSHIPTAVKIKGFSGEDARPALQGADVVLISAGVARKPGMDRSDLFNVNAGIVKNLVQQIAETCPKACIGIITNPVNTTVAIAAEVLKKAGVYDKNKLFGVTTLDIIRSNTFVAELKGKQPSEVEVPVIGGHSGVTILPLLSQIPGVSFTEQEVADLTKRIQNAGTEVVEAKAGGGSATLSMGQAAARFGLSLVRALQGEKGVVECAYVEGDGEHARFFSQPLLLGKNGIEEHQPIGKLSA

SEQ ID NO: 6343 - protein, 365 aa, Populus tremuloides
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLAKGAGFQGFEVMCCAFNTHVIEFRKKA

SEQ ID NO: 6344 - protein, 317 aa, Zea mays
MASDGSGVVTVYGNNGAALLEPPKQPKSSTFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVAGAVRALRGMDDDEVFAYAKRIAAPYDLVMQTKQLGRLPVVQFAAGGVATPADAALMMQLGCDGVFVGSGIFKSGDPARRARAIVQAVTHYSDPTILTDVSAGLGEAMVGINLNDPKVERYAARSE

SEQ ID NO: 6345 - protein, 335 aa, Fusobacterium nucleatum subsp. nucleatum ATCC 25586
MAVKVAINGFGRIGRLALRVMSKNKDFDVVAINDLTDAKTLAHLFKYDSAQGRFDGTIEVTDDGFVVNGDSIKVFAKANPEELPWKDLGVDVVLECTGFFTSKEKAEAHIKAGAKKVVISAPATGDLKTVVYNVNDNILDGSETVISGASCTTNCLAPMAKVLNDKFGIVEGLMTTIHAYTNDQNTLDAPHKKGDLRRARAAAENIVPNTTGAAKAIGLVIPELKGKLDGAAQRVPVITGSITELVTVLGKEVTVEEINAAMKAASNESFGYTEEPLVSSDIIGISFGSLFDATQTKVLTVDGKQLVKTVAWYDNEMSYTSQLIRTLKKFVEISK

SEQ ID NO: 6346 - protein, 996 aa, Nostoc sp. PCC 7120
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 6347 - protein, 238 aa, Triticum monococcum
MGRGKVVLQRIENKISRQVTFAKRRNGLLKKAYELSLLCDAEVALVLFSHAGRLYQFSSSSNMLKTLEKYQRYIFASQDAAVPTTDEMQNNYLEYMELKARVEVLQRSQRNLLGEDLAPLSTIELEQLEGQVGKTLRQIRSRKTQVLLDEMCDLKRKEQILQDANMTLKRKLGEIELEATPDPPQQPQQQQMWQGDRGVPPHTPPQPEHFFQALERYPSLQPVFRGMDVNQPPPAWMA

SEQ ID NO: 6348 - protein, 180 aa, Zea mays
MAEAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 6349 - protein, 313 aa, Halobacterium sp. NRC-1
MSFRRPTLGETPTTVLFLLLAAIWGSSFVAIKIGIADVPALSFAAIRYSIAGLIVLAYAAHTTDRWRPRGRREWVLAATVGLFVIGIYHGALYLGEHDVSAPIAAIVISLAPILTAGFASKLHENVTIDGTQAAGLLAGLAGVVIVANPGSAGSVDLGGLLLVFLAAASFALGGVLTGKLPGGGGLPVETMEAWAMLIGSLALWVGAAVRGENVTAVHWTPTALASLAYLTLVCGAGGFLLYFVLLERAGATEINLVSYLEPIGASVVAWALFGDVVSPRALAGFAVIFAGFALVKHRYIGAAVRNTTDDAEL

SEQ ID NO: 6350 - protein, 750 aa, Salmonella typhimurium LT2
MSHNEKSPHQSPVHDTRESQPGLDSLAPSDGSHRPTPETTPPGAQPTAPGSLKAPETANDKLTALDAFRKGSENYALTTNQGVRIADDQNSLRAGSRGPTLLEDFILREKITHFDHERIPERIVHARGSAAHGYFQPYKDLSDITKAAFLCDPQKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAQGKATFVRFHWKPLAGKASLVWDESQKLTGRDPDFHRRDLWEAIEAGDFPEYELGLQLIAEEDEFKFDFDLLDPTKLIPEELVPVQRVGKMVLNRNPDNFFAENEQAAFHPGHIVPGIDFTNDPLLQGRLFSYTDTQISRLGGPNFHEIPINRPTCPYHNFQRDGMHRMDIDTNPANYEPNSINDNWPRETPPAPKRGGFESYQERVDGNKIRERSPSFGEYYSHPRLFWLSQTPIEQQHIIDAFSFELGKVARAYIRERVVDQLAHIDVTLAQGVAHNLGFALTHEQTQIAPPPDVNGLKKDPALSLYAVPDGDVKGRVVAILLNDKVNAAELLTILQALKAKGVHAKLLYSRMGEVTADDGSTLTIAATFAGAPSLTVDAVIVPCGNIADIESCGDARYYLLEAYKHLKPIALAGDARRFKALLNIDSQGEEGLVEADNVDHHFMDTLLTLMAAHRVWSRAGKINAIPA

SEQ ID NO: 6351 - protein, 327 aa, Chlamydia muridarum
MSSQFDQLKLWSVLVGDSGDPDLIKTLDVQDATTNPSLILKVAQEPKYQSMLTEAISWGIRQNGDDVQTLTFVLDKIQVNLGLEILKYVPGRVSLEIDARLSFNTEAMVQRAIFLSQLFEKMGGDKKRLLIKIPGTWEGIRAAEVLENQGIACNVTLIFSLVQAIAAAKAKVTLVSPFVGRIYDWWIAAYGAEGYSIEADPGVASVANIYSYYKKFDIPTQIMAASFRTKEQVLALAGCDFLTISPKILEELKKEQQPVERKLSVEEAKKLDIQPVELSESVFRFLMNEDAMATEKLAEGIRIFSGDTQILESAVTEFIRQIAAQEA

SEQ ID NO: 6352 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 6353 - protein, 276 aa, Glycine max
MAATFFSHLSLLQSNNNNSPSLSPTPSRISHSLTNRVKPSLCGVSVGKRASGLVPKATLNAVEAISANKKSNNNPIVVIDNYDSFTYNLCQYMGELGFHFEVYRNDELTVEELKRKNPRGVLISPGPGAPQDSGISLQTVLELGPTVPLFGVCMGLQCIGEAFGGKIVRAPHGVMHGKSSMVYYDEKGEDGVLAGLSNPFLAGRYHSLVIEKGSFPHDELEVTAWTEDGLIMAARHKKYKHLQGVQFHPESIITPEGKTIVHNFVKLIERSEAVGS

SEQ ID NO: 6354 - protein, 248 aa, Zea mays
  unsure (1)..(248): unsure at all Xaa locations
MTMAGSCAAVPVAGLPSLRTPMPTHLRLGGFMPCSSAARSRGAAVLGCALGARKQTPGVLNQLLCRYMRRDGHEGDVSNQGRDGAVMFGPDDDGVKIPTQVETLVKGTAAVAEPEYKQIPDVDYLQELLAIQQQGPRAIGFFGTRNMGFMHQQLIEILSYAMVITKNHIFTSGASGTNAAVIRGALRAEKPELLTVILPQSLKKQPLXSQELLSKVQNLIELTKVQQVRVPRQQTADGNMPGGQDGRS

SEQ ID NO: 6355 - protein, 251 aa, Zea mays
LAARVGSHGEGSGGAQAGGGEINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 6356 - protein, 363 aa, Zea mays
VVHQWPGLPKGVKFDPSDQELIWRLMAKHGKSGIKPHPFIDEFIPTVEEDEGICYTHPQKLPGVKQNGSVSHFFHRTFKAYNTGTRKRRRINTDDADVRWHKTGKTKPVLVDGKHLGCKKIMVLYISPLKGGKAEKTNWVIHQYHLGTGEDERDGEYVVSKLFFQQQFKPGDKNAQELTTSDDLESMAAESNLPDFTTLPTDKHVGTVQEVVHNPEHNLYQLNRNCEISIEETVVLPPSVKTTKDGDNLQSQDQKLWEGDSQFELLDSQQLAEGLALCDEFLLSQSQTSCGGGDEPRETKPCLAAYAHLSAEDFKKDLEECQRLEPTDNTNLELDNTDEFRLSQIEFSQDSFMTWAAEKITDD

SEQ ID NO: 6357 - protein, 144 aa, Zea mays
  unsure (1)..(144): unsure at all Xaa locations
RSSRRAGILPSPSFLLSLFLSIPRRETRAPDWRRPPVREARQIFDSRGNPTVEADVCCSHGTFAKAAVPSGGSTGAYAPLKLRDGGSDYLGQGVSKAVNNVNSIIAPXLVGKDPTRXTLCFDIFMAQELDGTXNEWGVVQRKSL

SEQ ID NO: 6358 - protein, 716 aa, Kluyveromyces lactis
MESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 6359 - protein, 314 aa, Mesorhizobium mediterraneum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 6360 - protein, 828 aa, Cellulomonas biazotea
MTSQTALDPAALVASLPLETKVRLLTGATAFTLAPEESIGLGEVRLSDGPTGVRGLKFSGGRTVALFPNATLLASAWSEESTTEVGRLLAEEALAQQIHVVLGPTINLHRSVLGGRLFEAYSEDPLLTGRLAAAYVRGLQDLGVGACLKHLVANESETERNTMNSVVDPATLRELYLLPFEIAVDESDPWSVMAAYNDVNGVPATEHHHVVNEVLKGEWGYTGLVMSDWFATRTAAPAAAGGLDLVMPGPDGPWGDALVAAVRSGELDESVVDDHLRRLLVLAARVGALGDLRDYPDDLPAPDSAVRREQLTRLAAAGMTVLTNADDTLPLARGTRVALVGRHALETIDMGGGSATVNPPYQVSVAEGLTALLGDAVDVVDGVEVRTRPVPARPGFVVDPDTGRPGLHLTLLAADGTVLDERHDAPSTVMVGFDDDFPQAVARVRFRARVAGEGALEVGAIGVGRWQVTAGGTELAWTLATSGTGFAEEMLAPPTRTDQVHVGSDAVVDATVVLRSSTRSVTVGDADPGTDAGAAAEPLAGVGLFGLVARPAPEAEDDVITRAAAAAAQADVAVVVVGLTEEEETESVDKSTIALPGAQDALVRAVAAAARRTVVVVNAATPVLMPWLDDVDAVLWAGLPGQEGGHAVAAALLGDQEPTGRLVTTFPAADGAAPAWSVTPVDGDLEYTEGRFVGYRGHWADRAPAPAFWLGHGLGYATWEYADATLDTDGDAPAVTVTVTNTGARTSREVVQVYLEPASSDEPVRLVGWADATVDAGASARVTVTADARMWRRWDEAAGGWSRLADGGRLLVARGLGDVRATLALPTA

SEQ ID NO: 6361 - protein, 834 aa, Bifidobacterium longum DJO10A
MAESNQRTARAQKALKAQKAQSGAAKAKARQEEEALLRADTFTNAPKVSRRTLTKEEREALAKQREAETKEAEKIASAWSKGGLGRWWARLQSSPDKVTWGMAIVALGVVYGDIGTSPLYTAQTFLAGQGGLGGVDREAVLGMLSLVFWSITLITTVKYVLIAMRIDNNGEGGIFALYSLIRKYGAWLAIPAMLGGAAFLADSVLTPAVSISSAVEGLQTLPPLEGLFDENPSLTLMITVVIIVILFSVQSRGTESIGKVFGSMVLVWFGFLAIVGVTNLSNDWSVFEALNPVYGIKFLFSPHNAAGIALMGTVFLSTTGAEALYSDMGHVGRGNIYFTWPFIKVALVLNYFGQGAWMLANSDNPQYTATESLNPFFQMMSPNVRYLAVILSVSAGVIASQALITGAFTMVSEATRLNWMPHLQVRYPARTRGQLYIPVVNGVLCVSTLAVLAIFKDSEHISAAYGLALTITMITTTVLLGVYLWHSGKRVGAIVFTVLFLAIQAMFFIASMAKFLHGGWFTMLLTAAILFVMYTWNEGTKLERAQRRHMRPNDFLPALDKLHSDFRIPYFADNIVYLTSDSETKRLDTDIFFSIFADHPKRARAWWAVSVETTDEPFTREYSVEDFGTNYIYRVRFRLGFKVSQSIPAYIHQIMHDLSKTGELPKQKSIYPKVDADPDIGTIRYVLIHKALMPESKVSARGALSLQAKYAIRRMAGSPVKWFGLAPYNPLVEVQPLFVSTRRPPRLKRTDTAKTITTPTPTRAVADPAAVPDPMDTTSGLGRLVQELDAAVSAEERKIAETAAAAAVAEQGDKGKAKNGKPAAKPQRSSKQKR

SEQ ID NO: 6362 - protein, 603 aa, Lactobacillus plantarum WCFS1
MVMKQTKQTNILAGAAVIKVLEAWGVDHLYGIPGGSINSIMDALSAERDRIHYIQVRHEEVGAMAAAADAKLTGKIGVCFGSAGPGGTHLMNGLYDAREDHVPVLALIGQFGTTGMNMDTFQEMNENPIYADVADYNVTAVNAATLPHVIDEAIRRAYAHQGVAVVQIPVDLPWQQIPAEDWYASANSYQTPLLPEPDVQAVTRLTQTLLAAERPLIYYGIGARKAGKELEQLSKTLKIPLMSTYPAKGIVADRYPAYLGSANRVAQKPANEALAQADVVLFVGNNYPFAEVSKAFKNTRYFLQIDIDPAKLGKRHKTDIAVLADAQKTLAAILAQVSERESTPWWQANLANVKNWRAYLASLEDKQEGPLQAYQVLRAVNKIAEPDAIYSIDVGDINLNANRHLKLTPSNRHITSNLFATMGVGIPGAIAAKLNYPERQVFNLAGDGGASMTMQDLATQVQYHLPVINVVFTNCQYGFIKDEQEDTNQNDFIGVEFNDIDFSKIADGVHMQAFRVNKIEQLPDVFEQAKAIAQHEPVLIDAVITGDRPLPAEKLRLDSATSSAADIEAFKQRYEAQDLQPLSTYLKQFGLDDLQHQIGQGGF

SEQ ID NO: 6363 - protein, 357 aa, Clostridium pasteurianum
MKEFKIAVIPGDGIGPDIVREAVKIMTKVGEKYDTKFNFVEVKAGGDAIDAYGEPLPKETIDVCKSSAAVLLGAVGGPKWDNLEGSKRPERALLGLRGALGLYANLRPAKVYNVLKSASPLKNEIIDEGVDLLVVRELIGGIYFGDRGTKEVNGVETAFDTEKYNVDEVKRIAHSAFKAAMKRRKKVTSVDKANVLDASRLWRKTVNEVSKEYPEVELSHLYVDNTAMQLVRKPSQFDVILTNNIFGDILSDEASMITGSIGMLASSSIREDSFGMYEPIHGSAPDIAGLDIANPLAQILSAAMLMEYSLDMSEAARDVEAAVEKVLNEGYRTADIYIEGTKKVGTSEMGNLVLERL

SEQ ID NO: 6364 - protein, 244 aa, Nothotsuga longibracteata
TYTLRKKGPEDVIIRVIYCGICHSDLSAMRNEMGMSHYPMVPGHEVVGIVTEIGSEVKKFKVGEHVGVGFIVGSCRNCSNCNESNEQYCNKKIWSYNDVNPDGTPTQGGFASTMVVDQMYVVRIPENLSLEQAAPLLCAGVTVYSPMKHFGMTEIGKRCGILGLGGVGHMGVKIAKAFGLHVTVISSSDKKKEEALEVLGADAYLVSKDAEKMQEAAESLDYILDTIPVAHPLEPCLSLLKTNG

SEQ ID NO: 6365 - protein, 268 aa, Prunus persica
ELVSHGIPTEFLDTVERLTKEHYRQCLEQRFKELVASKGLEAVKTEVNDMDWESTFYLRHLPKSNISEAPDLEDQYRNVMKEFALKLEKLAEQLLDLLCENLGLEQGYLKKAFYGTNGPTFGTKVSNYPPCPNPELIKGLRAHTDAGGLILLFQDDKVSGLQLLKDGQWVDVPPMRHSIVINLGDQLEVITNGKYKSVEHRVIAQTDGTRMSIASFYNPGSDAVIYPAPTLVEKEAEEKNQVYPKFVFEDYMKLYAGLKFQAKEPLQF

SEQ ID NO: 6366 - protein, 232 aa, Glycine max
  unsure (1)..(232): unsure at all Xaa locations
MFGPAQFTSEPPKSTLKFLCSYGGKILPRYPDGKLRYLGGXHTRILAVDRSIPFSELLLKLEELCGASVRHLRCQLPSEDLDALVSITSDEDLANLIEEYDRVSSLKIRAFLSPPTPATPATPPRSPNKFSTAPSKSASISSSSASSSSSSSSYYSPTGSGESGRRYRAPALVSDCCVHQMSQPPAYPVGMEKSKSSGRNVPLPRYGYHHGNGGHVYLIHNGNHWQQRYGVV

SEQ ID NO: 6367 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 6368 - protein, 170 aa, Zea mays
  unsure (1)..(170): unsure at all Xaa locations
MAPTVMMASSATAVAPFQGLKSTASLPIARRSSRSLXNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 6369 - protein, 316 aa, Oryza sativa
  unsure (1)..(316): unsure at all Xaa locations
VCTIVVKPAAXAPLSALYYAHLAKLAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 6370 - protein, 258 aa, Triticum aestivum
  unsure (1)..(258): unsure at all Xaa locations
MGRKFFVGGNWKCNGTVEQVESIVNTLNAGQIASTDVVEVVVSPPYVFLPTVKAKLRPEIQVAAQNCWVKKGGXAFTGEVSAEMLVNLGXVPWVILGHSERRSLMGXKSSEFVGEKVAYALAQGLXKVIACVGETLEQREAGSTMAVVAEQTKAIADKIKDWTNVVVAYEPVWAIGTGKVATPAQAQEVHANLRDWLKTNVSPEVAESTRIIYGGSVTGAXSCKELAAQPDVDGFLVGGASLKPEFIDIINAATVKSA

SEQ ID NO: 6371 - protein, 412 aa, Escherichia coli CFT073
MADTRPERRFTRIDRLPPYVFNITAELKMAARRRGENIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDMAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 6372 - protein, 492 aa, Triticum aestivum
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 6373 - protein, 194 aa, Mitthyridium sp. Orban 8/1993
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIALSDTFV

SEQ ID NO: 6374 - protein, 362 aa, Geobacter metallireducens
MSQVFKVAVLPGDGIGPEVMAEALRVLDAIEKKYDVKFERTHANVGGAGIDLEGKALPETTITICKTSDAILFGSVGGPKWETLPPDEQPERGALLPLRKIFGLYANLRPAIIFPSLTGASSLKEEVIAGGFNVLVIRELTGGIYFAQPKGIEGEGRDRVGFDTMRYSVPEIERITHVAFQAARKRGKKVCSIDKANVLSSSVLWREVVTGIAKEYPDVELSHMYVDNAAMQLVRWPKQFDVILCENMFGDILSDEAAMLTGSLGMLPSASLAEGTFGMYEPSGGSAPDIAGQGIANPIAQILSMGMMLRFSFGMVDAADAIDNAVAKVLDQGCRTRDIFQEKPGEKLVNTKEMGDAIIVAL

SEQ ID NO: 6375 - protein, 347 aa, Leuconostoc mesenteroides subsp. mesenteroides ATCC 8293
MSEQRKAKAEDFDWDNLGFEYHDLPYRFRAYYKDGKWSEGGLETDSNIPVNEAATGLHYGQTIFEGLKVYRRKDGGANIFRPDRNAKRLQNSAARLMMAPVPEELFVRALKEVTKANQDFIPPYGTGATLYLRPFEFGGGPVVGVHPADNYVFEVYATPVGAYYKGGLTPTAYVTNHYDRAAHGGTGAAKAGGNYGASMLAGDEAHAAGYSDVVYLDPRLHENIEELGSANFFGITKDGRFLTPKSPSILPSVTKYSLLQVAEELGLKAEETTISINDLDQFAEAGAMGTAAVISPVGSITHNGNKHVFYSETEVGPWTQKLYDRLTAIQYGDQEGPEGWAVDVPLD

SEQ ID NO: 6376 - protein, 459 aa, Staphylococcus xylosus
MTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 6377 - protein, 487 aa, Streptomyces avermitilis MA-4680
MSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 6378 - protein, 332 aa, Prochlorococcus marinus subsp. pastoris str. CCMP1378
MKKTKVICIGEALIDRIKNKSNQEFTDFLGGAPANVACALRKLQIDSVFIGRIGSDEFGKKFINQFKELEVNINFLQLDDCLPTRIVKVNRDNSGDRYFSGFDTSLNTFFADEAFDKNEIKKDLKSLENLFSKTKYLVCGTIILSSSISADTINFLLSLANKFDVKIIIDLNWREVFWDFATSSSETNKKERVDLIRNLLNKAHILKLAKEEAILFFENKNPLEISERLLNRPDVIITDGANPICWLINGVQGTTEVSKSLKIIDTTGAGDAFLAGLISQLLSFDYPSNESEIQNCVKFASICGLLTCLGEGAIEQQPDYSKVNKFFGSQIL

SEQ ID NO: 6379 - protein, 488 aa, Porphyridium aerugineum
MDQSVQERTRIKNERYESGVIPYAKMGYWDPDYAIKATDVLALFRVTPQPGVDPVEAAAAIAGESSTATWTVVWTDLLTACDLYRAKAYRVDPVPSSPDQYFAYIAYDIDLFEEGSIANLTASIIGNVFGFKAVKALRLEDMRIPVAYLKTFQGPATGVVVERERMNNFGRPLLGATVKPKLGLSGKNYGRVVYEGLKGGLDFLKDDENINSQPFMRWRERFLFCMEGVNRASASSGEVKGHYLNVTAATMEDMYERAEFSKEVGSIICMIDLVIGYTAIQSMAKWARKNDMILHLHRAGNSTYSRQKNHGMNFRVICKWMRMAGVDHIHAGTVVGKLEGDPLMIKGFYNTLLEPHLNINLPEGLFFEQNWASLRKVMPVASGGIHCGQMHQLIDYLGDDVVLQFGGGTIGHPDGIQAGATANRVALESMLLARNEGRDYVAQGPQILRDAAKTCGPLQTALDLWKDISFNYTSTDTADFVQTPTANV

SEQ ID NO: 6380 - protein, 802 aa, Emericella nidulans
MRSLISVAVLSALAAFSQANTSYTDYNVEANPDLFPLCLQHLNASFPDCATGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGAVDPETSKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYDVALNNERSVVVKFELKGEEAVILSWPEDTTSDFVSSIDGGLDRKQDVIA

SEQ ID NO: 6381 - protein, 87 aa, Buchnera aphidicola
GLYEPAGGSAPDIAGKNIANPIAQILSIAMLVRYTMKLPMISDHIESAVIDTLKKGYRTLDIANDKEKYISTNDIGDIISDILKKRI

SEQ ID NO: 6382 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 6383 - protein, 228 aa, Streptomyces coelicolor A3(2)
MAAQINPSILSADFARLADEAKAVEGADWLHVDVMDNHFVPNLTLGVPVVESLARATDTPLDCHLMIEAPDRWAPQYVEAGAGSVTFHAEAAAAPVRLAREIRAKGARASMALKPATPVEPYEDLLPELDMLLIMTVEPGFGGQAFLDIMLPKIRRTRELIKKHGLELWLQVDGGVSAATIERCADAGADVFVAGSAVYGASDPAEAVRALRTQADAATAEASWSCDH

SEQ ID NO: 6384 - protein, 402 aa, Oryza sativa (japonica cultivar-group)
MAARSFSSASTTTILLRSGRWRRTMRAAAFPFRVSCSAAAAAAAGGTVVIGLAADSGCGKTTFVRRLTSVLGAGTAAAAAPPWGGNPGSNTLLGDAATVICLDDYHSLDRAGRKERGVTALDPRANDFDLMYRQLKAIKEGRAVAKPIYNHATGLLDPPELITPPKILVVEGLHPMYDERVRGLLDFSIYLDISSDIKFAWKIQRDMAERGHSLESIKASIEARKPDFDAYIDPQKQYADAVIEVLPTRLIAAADDDGDEGKVLRVKLIMKEGVEHFAPAYLFDEGSTISWIPCGRKLSCSYPGIKFSYFPDTYFGHEVSVLEMDGKFDKLDELIYVESHLSNLSTKYYGEVTQQMLKHADFPGSNNGTGLFQTIVGLKIRDLYEQVVAERAASPPALAAVA

SEQ ID NO: 6385 - protein, 324 aa, Oryza sativa
MPLPLFHRNISLLPLAANFSVIKSGVQPRCTHCSSAHPHSPRPHCLTAAAAATMPLLSSWLFHKLRRRRSAARGEPDVVEAASKKQQPPMAAAAAAAPCSPSPNRASYYFASRERCLPPARAATDNHKLRDTRFPRSPQPNDDIVFDVVAVSASPARGQFDGMKAMPELKLRPILTKRATAKNDGDEGDALDSGTSAAASPTSRVRRFVHHAKPSSGRRKGRVAALPADATSRRRRRRRRCRWLYESLVVVKESADPEEDFLESMAEMIAANDVRSPRDLEELLACYLALNAAEHHRAIVGAFRRAWLHAAAATAAPPSPSPIK

SEQ ID NO: 6386 - protein, 126 aa, Pectobacterium carotovorum subsp. carotovorum
NVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAK

SEQ ID NO: 6387 - protein, 796 aa, Streptomyces coelicolor A3(2)
MNADVTVDHTAEVSPWNDTTASVAARVDALIDAMTLREKTAQLYGVWVGASDEGGEVAPHQHDMEEAVDLDALLPTGLGQLTRPFGTVPVDPALGALSLARTQARITATNRFGIPALAHDECLAGFAAWGATAYPVPLSWGATFDPDTVGRMASAIGRDMRAVGVHQGLAPVLDVVRDARWGRVEETIGEDPYLVGTIGTAYVRGLESAGIVATLKHFVGYSASRAGRNLAPSSMGPRERADILLPPFEMAIREGGARSVMNAYTDTDGVPSAADEELLTGLLRDTWSFDGTVVADYFAIAFLKTLHGVAAEWADAAGLALRAGVDVELPGVKTYGAPLAEAVADGRVPETLVDRALRRTLTQKARLGLLDPDWNPLPAALEGADLDDPAALRGRIDLDSPANRALARTVAEEAVVLLSNDGTLPLARPRRIALLGPNADEAVAVLGCYSFPQHIGVRYPGTPHGIELPTLRVALAAEFPDARITFARGTGVDDGDLTGLPEAVRVAREADIALVVLGDRAGLFGRGTSGEGCDVETLALPGAQQRLLDALLDLGTPLVTVLLAGRPYSLGRAVEESAAIVQSFFPGEEGTHAIAGVLSGRVNPSGRLPVGVPRGPGSQPATYLGAKLAHAGEVSSIDPTPAFPFGHGLSYTRFDWTDLSVDDQEAPTDGEFTLTFTVRNTGGRSGTEVVQLYLHDPVASVVQPVQRLVGYARVDLEPGEARRLRVTVPADLASFTGRDGRRVVEPGALELRLAASSADPRLTARVALTGVERHLDHTRRLRSVVEQEPAARARAE

SEQ ID NO: 6388 - protein, 585 aa, Cyanidium caldarium
MNYKKNSLIKTGAFALIDMLVKHKVKNIFGYPGGAILPIYDELYHWEKKKLIKHYLVRHEQSAAHAADAYARATNEVGVCLATSGPGATNLVTGIATAQMDSVPIIAITGQVSRAFIGTDAFQEVDIFGITLPIVKHSFVVRDPRDISTIVSEAFYISKHGRPGAVLIDVPKDVGLEEFNYHDYDSIRDHKPITKYRPIYGPSIRQIEKFKKMLLESKQPILYVGGGAVMSRAQHEIEELASFIKIPVTTTLMGKGSFNEYNPLYLGMLGMHGTAYANFAVSECDLLIALGARFDDRVTGKLDEFACNAQVIHVDIDPAEIGKNRIPQLAIISDIKIVLKELLSSMKEGTNNMDKNQTQAWLHRIHKWKKEYPLSIPHDSKLLYPQEVINEISQIAQKAFFATDVGQHQMWAAQFLKVEQGKWLSSSGLGTMGYGLPAAIGAKIANPNDLIICITGDASFQMNLQELGTIAQYELDIKIFIINNQWQGMVRQWQQAFYDQRYAHSNMAKGQPDFVQLANSYGIRGIRVTTSKDLKSKIERIISTPGPLLIDCIVATSENCYPMIAPGKSNSQMLGLTKQLKTITN

SEQ ID NO: 6389 - protein, 462 aa, Vaucheria bursata
  unsure (1)..(462): unsure at all Xaa locations
GYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERLANFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLDTKLEINLPQGLFFEMEWAALRKTVPVASGGIHCGQMHQLLYYLGDDVVLQFGGGTIGLPXGXQAGATANRVALEAMVLARNEGRDYLNEGPQILRDAAKNCGPLKTALDLWKDITFDYTSTDTPDFVETATESK

SEQ ID NO: 6390 - protein, 113 aa, Buchnera aphidicola
DIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 6391 - protein, 388 aa, Streptococcus pyogenes MGAS315
MKNQLGQLALEQAKTFGGKLEVQPKVDITNKHDLSIAYTPGVAGVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEADQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPGDALSTTNIIPDAFKEGVAEIVAKSVRSVVLKS

SEQ ID NO: 6392 - protein, 78 aa, Zea mays
FVFEKNLVQSFRLLVDYACTPEEVQQHFQACGTVNRVTILTDKFGQPKGFAYVEFLEQEAVQEALNLNESELHGRQIK

SEQ ID NO: 6393 - protein, 544 aa, Vibrio vulnificus CMCP6
MTPTELKRLYRIIKVQLEYGLDDLLPDHQLAKAPRWMRKSLFWLKNQHPEKPLGDRLRLALQELGPVWIKFGQMLSTRRDLFPPHIADPLALLQDQVSPFDGALAKAQMEQALGGPLETWFSDFDLVPLASASIAQVHTAKLKTTNQEVVLKVIRPDIRPIIDADLKLMRRMARIVAKAMPEARRLKPIEVVREYEKTLLDELDLRREAANAIQLRRNFTDSEELYVPEVYPDFSNETVMVSERIYGIQVSDIAGLKANGTNMKLLAERGVSVFFTQVFRDSFFHADMHPGNVFVNPEHPENPQWIGLDCGIVGTLNSEDKRYLAENFLAFFNRDYRRVAELHVDSGWVPADTNIDEFEFAIRIVCEPIFAKPLCEISFGHVLLNLFNTARRFNMEVQPQLVLLQKTLLYVEGLGRQLYPQLDLWETAKPFLEEWMMNQVGPKALINAIKDRAPYWAEKLPELPELLYDSLKQGKAMNQRMDQLYQGYRASKRQQATGKFLFGVGATLVVCSAILVDHTYEQLSLATAIAGVTFWLFSWRAYRR

SEQ ID NO: 6394 - protein, 147 aa, Oryza sativa (japonica cultivar-group)
MAAAALTGQLNALVNNMFAMGLLDDQFQQLQMLQDSTAPDFVSEVVTLFCDDGERIICELSRQLEKPNVDFDRVDSYVHRLKGSSASVGAQKVKNTCIQFREFCQQKSRDGCLKTLDLVRTEFYDLRNKFQAMLQLEQQIQAWYPKH

SEQ ID NO: 6395 - protein, 488 aa, Shigella flexneri 2a str. 301
MKKVNHWINGKNVAGNDYFQTTNPATGEVLADVASGGEAEINQAVAAAKEAFPKWADLPMKERARLMRRLGDLIDQNVPEIAAMETADTGLPIHQTKNVLIPRASHNFEFFAEVCQQMNGKTYPVDDKMLNYTLVQPVGVCALASPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVRALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 6396 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIVSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSI

SEQ ID NO: 6397 - protein, 292 aa, Buchnera aphidicola str. APS (Acyrthosiphon pisum)
MKNYSQYHQDIMNQKLENIRNNIQCSFEFFPPKNSFLEENLWSTVNRLSLLKPKFFSVTYGANTGEREKTYDTVQKIYKKTGIITAAHLTCIDSTPHKLKEIAYNYWNSGIKSIVALRGDTLEKDYRHTMYAVDLVLLLKKIADFDISVAAYPELHPESKNVKSDILNLKKKVDAGASRAITQFFFNIESYLRFRDNCIKNKINIDIIPGILPVCNFQKLKRFSSMTNVKIPKWMLDMFNGLDDDIFTQKIIGSSIAIDMVKKLSCEGVKNFHFYTLNQSDITYSICHILGL

SEQ ID NO: 6398 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 6399 - protein, 196 aa, Mitthyridium sp. Magil and Crosby 8293
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSCDFITDSQSSIFDAKAGIALSDTFVKL

SEQ ID NO: 6400 - protein, 370 aa, Glycine max
MAKKSQLRTQKNNVTTNDDNNLNVTNTVTTKVKRTRRSVPRDSPPQRSSIYRGVTRHRWTGRYEAHLWDKHCWNESQNKKGRQVYLGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNNTNNVIDDQISINLTNINNNNNCTNSFTPSPDQEQEASFFHNKDSLNNTIVEEVTLVPHQPRPASATSALELLLQSSKFKEMMEMTSVANLSSTQMESELPQCTFPDHIQTYFEYEDSNRYEEGDDLMFKFNEFSSIVPFYQCDEFES

SEQ ID NO: 6401 - protein, 319 aa, Staphylococcus aureus subsp. aureus N315
MRRLFSIGEALIDFIPNVTNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 6402 - protein, 379 aa, Streptococcus pneumoniae R6
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEPGVVIRGTAEHPVVVKKGAKVTEDIHS

SEQ ID NO: 6403 - protein, 347 aa, Rhodomonas salina
CELRDGDDKRYLGKGVLKAVENVKSVIAPALAGMNPVEQDAVDNKMIQELDGTPNKTKLGANAILAVSLACCKAGAAQKGVPLYKHIADLAGTKKICLPVPWMNVINGGSHAGNRLAMQEFMIGPVGAKTFKEAMQMGCEVYHTLKKVIKKKYGQDACNVGDEGGFAPNIQANDEGLKLLTEAIEMAGFTGKIKIGMDVAASEFCKDKKYDLDFKNDASKPEDYLSPDALTDMYKGFCKDFPVVTIEDPFDQDDWEAYTKMTGEMECQIVGDDLLVTNPTRITTALEKKACNALLLKVNQIGSVSESIKAAKMSMDSNWGVMCSHRSGETEDCFIADLVVGLGTGQI

SEQ ID NO: 6404 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKESQ

SEQ ID NO: 6405 - protein, 175 aa, Enterococcus faecalis
MESTDVINEIRGILPRNSIGKYDLLTIFTHKTVFDKIVKVLSLDFQNKVDYVAAPEAIGWILGTAIAKELGVGFIGVRKGDKLPYAKEEIISTHFTDYSGQDKSFEISKSSIVRNKRVLIVDDWIETGSQMKALIALLEKLDCSIIGLATIGIDINEVTQKWIDSSFVAYIGSNI

SEQ ID NO: 6406 - protein, 376 aa, Pseudomonas fluorescens PfO-1
MDLQTILGKLFANAGAVGIEGVFQFVLGSQAFWSEVSASSRTEAGRHASPDVTIEVAEQDFLGIMAGIANVEELFASGRLKISGNMGLATMLPQIIDHARRGVAPVEKVDMNKRYPTPPRFSEKLTASLPAQTVVERRPRSELSLIEFESRYLPNGIPVVISNALHDWPLFRLSREESLVHFAELQGITRHGDYVKKTFSTERDFRSTSMADFIASLDSPAVKGADGEPPAYMGNNILPAALMEQIQYPPYFDASLFIPPRIWIGPKGTLTPLHRDDTDNLFAQVWGQKKFTLAAPHHREALGTWSTAPEGGLDGCDFNPDAPDYERFPKARDVTFMRVTLEAGDLLFLPEGWFHQVESVSTSLSVNFWVNSGRGW

SEQ ID NO: 6407 - protein, 373 aa, Oryza sativa
MIQTTPCVALLLLVGVAFAARSASAITDGLLPNGNFEEAPDKSQMNGTRVTGRYAIPQWEISGFVEYIGSGQKQGDMLLPVPEGAYAVRLGNEASIQQRLTLTRGMHYSITFSAARTCAQSELLNITITPESGEIPIQTVYTSSGWDSYSWAFKAKHSVVLFIVHNPGVSDDEACGPLIDSFAIKTLNPPQRTKGNMLKNGGFEEGPYIFPNTSWGVLVPPMDEDDYSPLSPWTILSTTKSVKYIDAAHYAVPGGARAVELVSGMETAMLQEVSTVPGRSYRLEFSVGDAGDGCSGSLTVQAYASRGSVKVTYQSQGTGGYKRGLLEFTATEKRTRVVFVSMAYTTKSDGTLCGPVIDDASLVSVHSHRRFLL

SEQ ID NO: 6408 - protein, 99 aa, Triticum aestivum
MSGAGEEDKKPAEAGGAHINLKVKGQDGNEVFFRIKRSTQLKKLMNAYCDRQSVDMNAIAFLFDGRRLRGEQTPDELEMEDGDEIDAMLHQTGGSVPGA

SEQ ID NO: 6409 - protein, 496 aa, Pastinaca sativa
MIGVWCMLLAYTLVSIGRIRAKATRKLPPGPFPLPIIGNIHKLGKHPHKSLANLAQVYGPIMRLKLGHMTTVVISSSTTARQVLRKQDIAFSNRALPNAVRALDHNKYSAVWLPVGSQWRGLRKIMSMNLFTANKLDANQHLRSQKVHDLIRYCEKCSQSGEAVDIGGAAFLTSLNLMSNTIFSKDMIDSYENSEAKVFRDLVWNIMVEIGKPNLVDYFPLLQWMDPQGIKRRLAYNFDTLIKLFDVMVDERLELNGPQNSRDVLDELLKLVNTDEIDKSHIQHMFLDLFGAGTDTSSSTVEWAMSEILRKPATVLVKAKAELDQVIGNGKIVEEADISKLDYLRCIVKETLRLHPPAPLLVPRQVQEEVELCGYTVPKNSQVLVNAWAIGRDPMLWENPLSFQPERFVDSEIDINGHGYELIPFGAGRRICPGMPLAMRMVPIMLGSLLNCFDWKLQGGIAPEDLNMEDKFGLTLAKLHPLRVVPTSRPTHLFAF

SEQ ID NO: 6410 - protein, 255 aa, Zea mays
MIGNFDNAFFRGVLDAPSVGSAKIPDIVFMLFQGMFAALTPALAIGAAAERGRILPTLVFIFLWTTFVYDFIACWTWSANGWSFVMGGLDFAGGTPVHISSGGAALAYALVLGRRSGDHKDFRPHAMSNVVIGTCFIRVRWFGFNGGSALSANLRAAMACVVTNLAASVGGITWVLLDYRHDRKLSVLGFCSGAVAGLVSITPGSGYVSPASSVAIGFLGACACNMAVRLKHYLKYDHALEVLGVHGVGGIVGNS

SEQ ID NO: 6411 - protein, 438 aa, Streptococcus agalactiae
MAIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLDKCGR

SEQ ID NO: 6412 - protein, 50 aa, Zea mays
GRVGGRVGGRVGPPGTPVVNALAKQRAMLENIMRACVGLAPENNMILEYK

SEQ ID NO: 6413 - protein, 419 aa, Grateloupia asiatica
DTDVLALFRVTPQPGVDPIEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKTW

SEQ ID NO: 6414 - protein, 488 aa, Leptospira interrogans serovar lai str. 56601
MSEKTKIAIAYGDGIGPEIMDATLKILNAAGAKIEPIEIEIGEKVYKEGHSSGIKPEAWDILRQTKVFLKAPITTPQGGGYKSLNVTVRTTLGLFANVRPCFSLYPYVETKHPSLDIVIIRENEEDLYTGIEHRQTNDTVQCLKLISHPGSEKIIRYAFEYARAYGRKKVTAMVKDNIMKQTDGLFHDIFKEVAKEYPELEVNSQIIDIGAANLADRPQNFDVVVTLNLYGDIISDIVAQIAGSVGMAGSSNIGEIVSMFEAIHGSAPDIAGKNLANPSGLLNAAVMMLVHIGQPDIAAKINNAWLLTIEEGIHTGDIFKPGVSRIKVGTKEFSDAVIGNLGHLPGKFKPVSFGKAKKIIIPEYKRNIQKKDLVGVDIFLDWVGKDPNELGNKLKSVSDELMLKIITNRGVKVYPDGQPETFLIDHWRCRFVSKNALIKQEDPSYHPISHKQVAELLLKLDLAGFDTIKTENLYYFNGKRAFSLGQGE

SEQ ID NO: 6415 - protein, 470 aa, Synechococcus sp. PCC 7942
MFDKRWRTLGLTAALAGISAFLLAHPTLAATAPQLTLEQLNSNVTAAKTGTDTLLLLIGSALVLLMTPGLAFFYGGFGRAQNVLNIMMMSFLMMGLVGMTWVIYGYSLAFDTSLGSPFIGGFSNLFFNGVGGKFGIDPVWAGDELMISGMSASSFALFQGMFAIITPALISGALVERVNFKAWFWFGLLWSTLVYIPMAHMVWGSNGFIYGQIGALDFAGGTVVHIASGVGALVSVAMIGPRRVFPNRLSPPHNVPFILLGAGLLWFGWFGFNGASYFAAQGAGFAFLTTNTAAATAMLTWLLLEQIDLGKPTAVGAATGAVAGLVGITPSAGFIPVWAALPIGALTALVCFLFVAKVKSRIRLDDSLDAFGVHGVGGTVGAILTGIFAQKDFLVEKAFPTQFKVISQGPLAMTWAQIQAVLITYLFVGIATFVIWTILKSVMRVRATEEQELEGLDFALHGEDAYSKER

SEQ ID NO: 6416 - protein, 566 aa, Bacillus subtilis subsp. subtilis str. 168
MKQFRVTNEGDIQTTLRGLEVLSVPFLNKGVAFTEEERKELGLKGFLPPKVLTIDDQAKRAYEQYSAQPDDLSKNVYLTALHDRNETLFYRLLNDHLGEMLPIVYTPTVGTAIQRYSHEYRKPRGLYLSIDDPDGMKEAFKQYKDQSDTIDLIVATDAEGILGIGDWGVGGIAISIGKLAVYTAAAGIDPSRVLAVVLDAGTNQESLLNDPLYVGNQHSRVRGERYDQFIDDYVALARETFPNALLHWEDFGAKNARSILKRYKDKVCTFNDDIQGTGAVSLAAVLSCAKASKVPLRDHRVVIFGAGTAGIGIAEQLREALVREGLSEEESYKRFWCIDRNGLLTDDMDQLLDFQKPYARSADEVKDYQRNGDGGGIDLLEVVRQAKPTILIGTSTVSGAFTEEIVKEMASHVKRPAILPMSNPTTLSEAKPEDLIEWTEGRALITTGSPFPPVEYNGVTYHIGQANNALVFPGLGLGTIVTKSKLITDGMFEACARAIAGMVNVGVPGAPMLPKVEDLRTVSATVAVEVAKTAMKEGVATEEPEDIIQAVQDAMWYPVYKPIRAI

SEQ ID NO: 6417 - protein, 260 aa, Tuckermannopsis chlorophylla
NDPFIEPHYAAYMLKYDSQHGQFKGTIEVKGSNLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGDLKGIMSYSEDALVSTDLNGDNHSC

SEQ ID NO: 6418 - protein, 516 aa, Cryptococcus neoformans var. neoformans
MFQKVSDKFHRKQQSTTLPGKTQQVPNPTSPVLAKANSQAQQAYSLPQDHSPMEGIQRDSPPIQQPMATEKAPIVGSSASTSLPTLSVQDGTLPLTPGAQGMQTGTIDGHRQLQSPVSRSSSAGEDKMREKARDAQEQAAQSQANLHHATQQARVAAINAAATQAALETAAQLPATARVPVSGGGVEQGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTNFGFAKYVPDITWTLCGTPDYLAPEVVQSKGYNKSVDWYALGVLIFEMLAGYPPFFTEDGNPMKLYEKIIAGKVRYPTYFDALAKELLKNLLIGDLTKRYGNLRAGSSDIFAHGWFAEVDWDKLYRREIPAPYVPKIDGEGDASQFDRYQEADVSAYGKVGNGPYDHFFTEF

SEQ ID NO: 6419 - protein, 65 aa, Triticum aestivum
LFGYQQPVSLELTEAAMVLCAERLSGLVNDAYTDVHRRSVQALKVRLAELAQSLGMLAGLGDALK

SEQ ID NO: 6420 - protein, 425 aa, Glycine max
  unsure (1)..(425): unsure at all Xaa locations
MGQGTPGGLNRQGLPGDRKPDGGDKKEKKFEPAAPPARVGRKQRKQKGPEAAARLPTVTPLSKCKLRLRLKPQEEKAEEDRSKVDDLRGSPMSVGNLEELIDESHAIVRSSVGPEYYVGILSFVDKDQLEPGCAILMHNKVLSVVGLLQDEVDPMVSVMKVEKAPLESYADIGGLDAQIQEIKEAVELPLTHPELYEDIGIKPSKGVILYGEPGXGKTLLAKAVANSTSAPFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 6421 - protein, 480 aa, Triticum aestivum
  unsure (1)..(480): unsure at all Xaa locations
MDVPLASKTFPSPSPSXREQCNVDGHKSSSKHADLNPHANDSVLGITLGGGAGTXRLYPLPKKRAKPAVPLGAHYRLIDIPVSNCLNSSISKIYVLTQFNSASLESSSXRPYGRHIGGYKNEGLXEILAAQQSPANPEWVQGPACAVRQYLGRVEEHNVXEYLIICXDHLYRMXYEKFIHAHRRNRSXDLTVAAFPMDEEXRATAFGPYEYXKKGWMIEFSEXTKSSRIXKAMFETIILDRVEARTKEITSITTMGSVVVSKHVVLQLLPEEFPGANDFGGEVITGGTSTGMMVQAYLXDGYWEEFSTIEAFYNENLGIIKKPIPHFSFYDRYAPINTQXRHLPPSKVLDADVTDSVIGEGCVIKNCKIHHSVVGLXRSCISEGAIIEXDTLLMGCGLLMRLKADKKNSLXTKGGLPIGIGKNSHIKRAIIDKNARIGDNVMIINVDNVQEAAGEKDEYFNKSVIVTVIKDALLPGGTVR

SEQ ID NO: 6422 - protein, 204 aa, Triticum aestivum
  unsure (1)..(204): unsure at all Xaa locations
MAFDFDHERLCALKAFDETKAGVKGLVDAGITAIPSIFHHPPESFAPLAPFSTDVAIPVIDLSGRRSEVVSTVKAAIEKLGFFLVVNHGVPEVAMSNMLSVVRGFHEEPAEAKEIYYTRDEERQVKYSGNADLFRSPAAKWRDTMYINDADRLAEEILPPVCKGVVPEYTRLMRXLGRFLVGIVSEASGVAAWIPGRTKPGWPR

SEQ ID NO: 6423 - protein, 417 aa, Pyrobaculum aerophilum str. IM2
MYKKVRVVLENGDVFEGVMLPPTQFSDSDIVVLKLKNGYNVGFKKGRIKEIVELGEVQTAPLSAKPMPKIEGEKVWLLATGGTILSRVDYVTGGVYPTLSVDYLFEVLGGLEAPIEAEEVTAKFSEDMTPALWGVIAERVAEAFKKGARGVVVLHGTDTMQYTAAALAFAFKSAPGPIALVGAQRSSDRPSTDAVLNLKAAIAVTARAPFAESVVVMHKTSGDTVVAVHRGTRVRKMHTSRRDTFQSINTTPIAEYYPEKELLQVLTDVYKERGGLDYTAKFEEAVALVKFYPGMHPRLLEALLEVGMKGVVIEGTGFGHVGEGVLPAVKKLIDAGVIVAMTSQTLYGRVNLYVYRRGRELLSMGVIPLEDMLPETAYAKMSWALANFKREEVPRVLTTPIAYEMSPRSDPLVFGGL

SEQ ID NO: 6424 - protein, 378 aa, Glycine max
MGVSGNNEVLVTTKVVVDYDRASELKAFDDTQDGVMGLTDAGVTKIPLIFHNPKNSHHDESDDGSGSTQLSVPSIDLVGVAEDPATRKVVVEKIRQACETWGFFQVVNHGIPLSVLEEMKSGVNRFYEQDSEVKRELYTRDPLRPLVYNSNFDLFTSPAANWRDTFYCFMAPHPPKPEDLPSVCRDILLEYAKEVKKLGSVLFELLSEALELNPNYLNDIGCNEGLTLVCHCYPACPEPELTLGATKHTDNDFITVLLQDHIGGLQVLHENRWVDVSPVPGALVINIGDLLQLITNDKFKSVEHRVVANRVGPRVSVASFFSTSLQPSTKLYGPIKDLVSEDNPPKYRETTVQGYVSYSLGRGLDGTSPLPHFRIKDF

SEQ ID NO: 6425 - protein, 428 aa, Trichodesmium erythraeum IMS101
METAIESIQAREILDSRGRPTVEAEVHLVNGSMGLAQVPSGASTGSFEAHELRDGDKGRYSGKGVLTAVKNVEEQITPNLVKINALNQNLVDSKMIEIDGSPNKSNLGANAILAVSLATAKAAANSVGMPLYRYLGGPQASLLPVPLMNVINGGAHAANNVDIQEFMIVPVGATSFKEALRWGAEVFATLSGVLKDKGLLGGVGDEGGYAPNLGSNQEALDILIAAIEKAGYKPGEQVALALDVAASEFYKDGNYIYDGATHSPSELIDYLASLVDQYPIVSIEDGLHEEDWESWVQLTQKLGSKVQLVGDDLFVTNGSRLQKGIDMAAGNSILIKLNQIGSLSETLETIDLATRNSYRSVISHRSGETEDTTIADLAVGTRAGQIKTGSLCRSERVAKYNRLLRIEDELGDRAVYAGVIGLGPKSRS

SEQ ID NO: 6426 - protein, 369 aa, Magnetospirillum magnetotacticum
MAAKKLLILPGDGIGVEVMAQVRRIIDWMARKRKVEFEITEGLLGGAAYDVHGTPYPAETLEAALAADAVLLGAVGGPKWDDLPFDKKPERGLLGIRKDMGLFANLRPATVLDALADASTLKNEVVSGLDIMILRELTGGLYFGQPRGIDTLPDGTRKGYNTLVYTTPEIVRIGRVAFDLARKRNKKLCSVDKANVLECTVLWREEMIKLQKEEYPDVELSHMYVDNAAMQLVRNPKQFDVMVTENMFGDILSDCAAMLTGSLGMLPSASLGEADANGKRKALYEPVHGSAPDIAGKDMANPLATIMSFAMCLRYSFDMVAEADLIETAVKNVLKGGLRTADIMQPGKAKVSTTVMGEAVVRELDKLNS

SEQ ID NO: 6427 - protein, 149 aa, Glycine max
  unsure (1)..(149): unsure at all Xaa locations
MAHDTTVGLSMAGVVAPFTGLKCMAGFPTRKTNNDITSIASNGGRVQCMQVWPPVGKKKFETLSYLPDLDDAQLAKEVEYLLRKGWIPCLGFELEPRFVYREHNRXPGYYDGRYWTMWKLAMFGWPGASQEWNELKELPLYTGAGYCYH

SEQ ID NO: 6428 - protein, 337 aa, Neurospora crassa
MSKAADIPKEQWAQVTEKDGVITYKKIPVPTPGHDEVLVNIKYSGVCHTDLHALDNDWPLPRKTPVIGGHEGAGVVVQKGELVTNVDIGDKVGVKWLMSTCFHCTFCQQALESLCPKAQLSGYTKDGTFQQYCVANAAHLARFPPQTDLSAVAPIMCAGLTVYKGLKESDTRPGQYVAIVGAGGGLGTIGIQKRGEACKKLGASMYIDFKESKDLVADVKKATHDGLGPQGVVLLAPQEQPFQQATGYVRSHGTVVCIGMPAGAKVSMPVFDTVVRMIKVKGSYVGNREDTAEALDFFLRGKVHAPYKVIGLSQLQSVFDEMRANRVIGRYVMDMSK

SEQ ID NO: 6429 - protein, 477 aa, Cryptopleura lobulifera
KNERYEPGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLFSQLEVNLPQGIFFKQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVETPTANI

SEQ ID NO: 6430 - protein, 64 aa, Zea mays
VQNLLEKPQYDHLPLIEASRLCNMDIISKVQQVICFAFHDSKLLMETCQEAMNLRKIVTLFYLD

SEQ ID NO: 6431 - protein, 901 aa, Zea mays
MDHVPALVLAGCCFLALLPGWACGLGSMSSIAVSYGEDGPVFCGLNSDGSHLVACFGADASVLYGAPPNIPFLGLTAGDGFVCGLLLDTRQPYCWGSNSYVKSGVPQPMVEGARYSELSAGDNHLCALRAAQDGGRGSSAATSLIDCWGYNMTATHAVDEAVSTVSAGSVFNCGLFARNRTVFCWGDETVSGVVGLAPRDLHFQSIGAGGYHVCGVLENAQVFCWGRSLEMQQVVPSSAIGDGDVNIVPMDAMSTVVGGRFHACGIRSLDHQVACWGFTLHNSTSPPKGLKMYALVAGDYFTCGVPAETSLMPRCWGNSGPLALPMAVPPGICVPTACSHGYYEYVNHGEVGSIKVCKPANSRLCLPCSTGCPEGLYESSPCNATADRVCQFDCLKCVTDECLSFCLSQKRTKSRKLMAFQMRIFVAEIVFAVVLVLSVSVTTCLYVRHKLRHCQCSNRELRLAKSTAYSFRKDNMKIQPDMEDLKIRRAQEFSYEELEQATGGFSEDSQVGKGSFSCVFKGILRDGTVVAVKRAIKASDVKKSSKEFHNELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDIFAILDPVLSPPSDLEALKKIASVACKCVRMRGKDRPSMDKVTTALEHALALLMGSPCIEQPILPTEVVLGSSRMHKVSQMSSNHSCSENELADGEDQGIGYRAPSWITFPSVTSSQRRKSSASEADIVGRRATDGRNVGSSIGDGLRSLEEEIAPASPQENLYLQHNF

SEQ ID NO: 6432 - protein, 478 aa, Gymnogongrus chiton
VKNERYESGVIPYAKMGYWDPDYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEDMYERAEFAKQLGSIIIMVDLVIGYTAIQSMAIWARKNDMILHLHRAGNSTYSRQKSHGMNFRVICKWMRMAGVDHIHAGTVVGKLEGDPLMIKGFYNTLLLPYLEVNLPQGIFFEQDWASLRKVTPVASGGIHCGQMHQLLDYLGNDVILQFGGGTIGHPDGIQAGAIANRVALETMVIARNEGRDYVAEGPQILQDAAKTCGPLQTALDLWKDITFNYTSTDTADFVETPTANV

SEQ ID NO: 6433 - protein, 519 aa, Oryza sativa (japonica cultivar-group)
MEEPTSCYGYYHYLALAVAVLVLVRVTRTRGGGSDGVRLPPGPWRLPVIGSLHHLAGKPLVHRALADLARRMDAPLMYLRLGEVPVVVATSPGAAREVMRTHDVAFATRPVSPTVRIMTADGEGLVFAPYGALWRQLRRIAILELLSARRVQSFRRVREEEAARLAAAVAAAAPHGEAAVNVSERIAVLIADSAVRAMIGDRFKKRDEFLEALAEGLKLVSGFSLADLFPSSWLASFVTGAARRAQENHRKNFELMDRAIEQHQERRAAAAAASGDVVEDDDLVDVLLRIQKGGGLDVPLTMGIIKAVILDLFSAGSETSATTIQWAMSELMRNPRVMKRAQAELRDNLQGKPKVTEEDLTDLNYLKLIIKETLRLHLPAPLLLPRESRESCKIFGYDVPKGTTVLVNAWAIGRDPKYWDDPEEFKPERFEDSKIDFKGLDFEFLPFGSGRRMCPGIMFAQPNIELALATLLYHFDWSLPAGVKPSELDMTEEMGITVRRKNDLYLHAVVRVPLHATTP

SEQ ID NO: 6434 - protein, 183 aa, Malus sp.
MASSMISSGTVATVSADRPAPAQARMVAPFTGLKSSSASPVTRKSNDITSIASNGGRVQCMQVWPPLGLKKFETLSYLPPLSTESLAKEVDYLLRKNWVPCLEFELEHGFVYRENHRSPGYYDGRYWTMWKLPMFGCTDSSQVLKELEEAKKAYPQSFIRIIGFDNVRQVQCISFIAYKPAGF

SEQ ID NO: 6435 - protein, 235 aa, Leersia virginica
LENKISRQVTFAKRRNGLLKKAYELSLLCDAEVALIIFSGRSRLFEFSSSSCMYKTLERYRSCNYNSQDAAAPENEINYQEYLKLKTRVEFLQTTQRNILGEDLGPLSMKELEQLENQIEVSLKQIRTRKSQALLDQLFDLKSKEQQLQDLNKDLRKKLQETSAENVLYMSWQDGGGHSGSATVLAADQPHHHQGLLHPHPEGDHSLQIGYHHTHHHHQAYMDHLNNEADMVAHH

SEQ ID NO: 6436 - protein, 298 aa, Glycine max
MSSRVWFLLFLLLISKCDHVWSSYAGSASSVINPSKVKQISWKPRAFVYEGFLTDLECDHLISLAKSELKRSAVADNLSGESQLSDVRTSSGMFISKNKDPIVAGIEDKISSWTFLPKENGEDIQVLRYEHGQKYDPHYDYFTDKVNIARGGHRIATVLMYLTDVAKGGETVFPSAEEPPRRRGAETSSDLSECAKKGIAVKPRRGDALLFFSLHTNATPDTSSLHAGCPVIEGEKWSATKWIHVDSFDKTVGAGGDCSDNHVSCERWASLGECTKNPEYMIGSSDIPGYCRKSCKAC

SEQ ID NO: 6437 - protein, 242 aa, Populus tremuloides
MGRGRVQLKRIENKINRQVTFAKRRNGLLKKAYELSVLCEAEVALIIFSNRGKLYEFCSGSSMLKTLERYQKCNYGAPEPNVSAREALELSSQQEYLKLKARYEGLQRTQRNLLGEELGPLSSKDLESLERQLDMSLKQIRSTRTQYMLDQLNDLQHKEHMLTAANKSLKERLMEGYQLNSLQLNPSAEDVEYARQQAQPQGDGFFHALECEPTLQIGYQPENITMVTAGPSMTTYMPGWLA

SEQ ID NO: 6438 - protein, 297 aa, Bacillus anthracis str. A2012
MQVGLIGLGKMGLNLGKNLIDHKHEVAAFDLNASAVEEMKEYGATGASSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 6439 - protein, 147 aa, Triticum aestivum
  unsure (1)..(147): unsure at all Xaa locations
MXPTVMGSSGTSVAPFQGLKSTAGLPVSRRSNGASLGSVSNGGRIRCMQVWPIEGIKKFETLSYLPPLNXEXLLKQVDYLIRSKWXVACLXFSKGGFIFREHNATPGYYEXXVLGKCGKLAMFGVEPTPQXVINEVGRRSKKGVTLA

SEQ ID NO: 6440 - protein, 300 aa, Arabidopsis thaliana
MFGLRKSPANLPKHNSVDLKSSKPNPFDSDDESDNKHTLNPSKRTTSEPSLADMTNPFGGERVQKGDSSSSKQSLFSNSKYQYKNNFRDSGGIENQSVQELEGYAVYKAEETTKSVQGCLKVAEDIRSDATRTLVMLHDQGEQITRTHHKAVEIDHDLSRGEKLLGSLGGMFSKTWKPKKTRPINGPVVTRDDSPTRRVNHLEKREKLGLNSAPRGQSRTREPLPESADAYQRVEMEKAKQDDGLSDLSDILGELKNMAVDMGSEIEKQNKGLDHLHDDVDELNFRVQQSNQRGRRLLGK

SEQ ID NO: 6441 - protein, 241 aa, Pisum sativum
MDTTQWPQEIMVKPLATNTSEKKPRPEKQQAVNCPRCNSINTKFCYYNNYSLTQPRYFCKTCRRYWTQGGSIRNIPVGGGTRKNNKVIRSSSNLVSNPTKNLVPSILVTSSQNQKHHEQGQDLNLDFTSVSSHSFSALELLTGITASTTRGFHSFMPVQLQGDSNTSNIGFPLQDFKQVPMNFCLDGIGGNGYGNEGRVLFPFEDLKQDLDQNNNKGDQQGYTTGFWNGMLGGGGGGYNGN

SEQ ID NO: 6442 - protein, 323 aa, Saccharum officinarum
MAPALSFPIIDMGLLGGEERPAAMELLRDACESWGFFEILNHGISTELMDEVEKLTKDHYKRVREQRFLEFASKTLKDAQDVKAAENLDWESTFFVRHLPESNIAEIPDLDDDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 6443 - protein, 423 aa, Microbulbifer degradans 2-40
MTLPKDPESSTVKPVKKDKRKNIIKSEKLLGVCYDIRGPVLEHANRLEEEGHRILKLNIGNPAPFGFEAPDEIITDVVYNIREAQGYTASRGLFPARKAIMHECQRQEIPNVEIEDIFLGNGVSELIVMANQALLNNGDEVLVPSPDYPLWTAAVNLAGGKAVHYMCDEQSDWFPDIDDMRSKITSRTRAIVVINPNNPTGAVYSQELLEQIVALAREHQLVIFADEIYSKILYDDAEFVPMGRIAKDVLCVTFNGLSKSYRLAGFRSGWIILSGAKHLAKDYIRGIDMLASMRLCANVPAMLAVQTALGGYQSINELILPGGRLLEQRDAAIEELAKIPGVSCVVPKGAIYLFPKIDRTMYDFDDDQQLILDFLIQEKILLVQGTAFNWKQPDHFRIVFLPQADQLRQAIIKFGEFLQQYRI

SEQ ID NO: 6444 - protein, 753 aa, Oryza sativa
MVRSTCCVVLLLLLSVAARSASAIMDGLLPNGNFEEAPDKSQLNGTRVIGRYAIPQWEISGFVEYIGSGQMQGDMLLPVPEGAYAVRLGNEASIQQRLTLTRGMHYSVTFSAARTCAQSELLNITVTPEIGEVPIQTVYTSSGWDSYSWAFKARRSDVSLIVHNPGVTDDAACGPLIDSFAIKTLQSPPSTKDNLLKNGGFEEGPYIFPNTSWGVLVPPMDEDDYSPLSPWTIMGYTKSVKYVDAAHYAVPGGARAVELVAGMEAALVQEVCTVPGRSYRLEFSVGDAGDGCVGSMSVQAYVSHGSVKVPYESQGRGGYKRGVLEFTATDKRTRVVFVSMAYTMKPDGTLCGPVVDDASVVGVHSHRRLLLEQLVVERLSPEDRHMTTPAMGHGPVETGAESSIRGGMPRLLPNGNFEDGPDKSQLNGTVVTGRYAILNWEISGFVEYIESGHREQDMILAVPEGARAVRLGNDATIRQRLSVTRRAYYSITFSAARTCAQKEKLNMSVTPEFGVLPIQTVYTSSGWDSYSWAFRAKHSVVWLSIHNPGEEEDPACGPLIDSIAIKNLYPPPRTKGNMLRNGDLEEGPYIFPDATWGVLVPPIFEDEHSPLPGWMIMSDTKVIKYVDSPHHRVPQGARAVELVAGRETALVQEVATVPGRSYRLSFSVGDAGNGCKDSLAVEAYAARATAKVPYESQGTGGHKRAQLEFAAVANLTRVVFQSFNYHTKPDGTLCGPLVDDISLVSVRKRAARL

SEQ ID NO: 6445 - protein, 262 aa, Trichoderma harzianum
MGHEDAVYLAKLAEQAERYEEMVENMKIVASEDRDLTVEERNLLSVAYKNVIGARRASWRIVTSIEQKEESKGNSSQVTLIKEYRQKIENELAKICDDILEVLDQHLIPSAKSGESKVFYHKIKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETPARLMPLLRRRPLLRLPSRRRRAQG

SEQ ID NO: 6446 - protein, 162 aa, Zea mays
  unsure (1)..(162): unsure at all Xaa locations
ECVEPAXDILDALSAVPEGRTALKDCPRTIPNAVRVLMRVSEACTRRALSMLWTVCRMAPEECAPAAVEAGLAAKLLLVIQSGCAPELKQKASELLKLCRLNCTDTLFISKCKLTRTIQGEKKQAMQHDYWQAGGXYMQIDVDLXQLNKHLRLGGKYSQFCH

SEQ ID NO: 6447 - protein, 281 aa, Eremothecium gossypii
MAPKRGSSPAIAGHCSLILSRGLPSVRVTDSNRQKKLIRHLHTFLLYLPADTSCGYRPECGAASFRTRQSSLMVSSEMPNTSTLRLCTVCASNNNRSMESHRVLKEAGYDVSSYGTGSAVRLPGLSIDKPNVYPFGTPYNDIYNDLLAQSAERYKSNGLLEMLDRNRRIKKAPEKWHDSQKVFDFVFTCEERCFDSVCEDLMNRGGQLNKIVHVINLDIRDDNENAKIGGRAMLELVKALNSKMQECDQQGVPFEDTIMDVVADWQQAHPQLPLLYSPAYY

SEQ ID NO: 6448 - protein, 690 aa, GIBBERELLA ZEAE PH-1
MRAGPFIGRFFVHPGLRTCPNVRPNISILSRRFASQSSRHPRFTKWSTPTSRRIALQASGGAVALGTAAFVELSQQENGNDQETGEKRMLEASRAEVRKGVRAESRGLTRVGERIKYLIDLLIIEPVCTGFRFLQLVVIFVPVIITIPAIYFGSRRPDRDNERSGTLWWYGFLVNEMELAGPAFIKLGQWAASRTDIFPTEMCEIMSKLHSNAPAHSLHATRVTVEAAFGGLPFEEIFEEFHEKPLGVGAIAQVYKAKLKPGLAKPEEAELHDSYHLAQNVKRNVDTVLKSSPQRIPSSYVAIKVLHPRVERTVRRDLRIMGFFASLLNLIPTIEWLSLPDEVTQFGEMMKLQLDLRIEAANLATFRKNFKDRSTAWFPYPYTEYTTRNVLIEEYAQGIPLADFMENGGGVFQHDIADEGLDAFLRMLLLDNFVHADLHPGNIMVRFYQSAHPDLRLRKAMTKAHPDEAEDVTEQVLERLRPYRHRKDTKAWQDELAKIDAEGFRPQLIFIDTGLVTELNAVNRENFLDLFRAVAEFDGYKAGHLMCERCRQPDAVLDKEVFALKMQHLVLSVKSRTLALGNVKIGDILQEVLSMVRNHHVRLEGDFVNVVISILLLEGIGRSLNPDVDLLSSSLPILRQLSAQSGTSMAKHGDFSMLVVWLGLEARRFMQASIEDVERCVKYDQLSPNI

SEQ ID NO: 6449 - protein, 371 aa, Glycine max
MEVSITDEIAGTMELNPDRLGELKAFDDTKAGVKGLVDEGVAKIPRLFHHPPDEFVMASKLGNTEYTIPVIDLAEVGKDPSSRQEIIGRIREASERWGFFQVVNHGIPVTVLEDLKDGVQRFHEQDIEEKKELYTRDHMKPLVYNSNFDLYSSPALNWRDSFMCYLAPNPPKPEDLPVVCRDILLEYGTYVMKLGIALFELLSEALGLHPDHLKDLGCAEGLISLCHYYPACPEPDLTLGTTKHSDNCFLTVLLQDHIGGLQVLYQNMWIDITPEPGALVVNIGDLLQLITNDRFKSVEHRVQANLIGPRISVACFFSEGLKSSPKPYGPIKELLTEDNPPKYRETTVAEYVRYFEAKGLDGTSALQHFKI

SEQ ID NO: 6450 - protein, 303 aa, Oryza sativa
MGRGPLGAAGAGRLAVGAAVLFPLRLAAGVLVLVAYYLVCRVCTLRVEEEEREGGGGGAAGEVEGDGYARLEGWRREGVVRCGRALARAMLFVFGFYWIREYDCRFPDAEDEHQEQSKELGRPGAVVSNHVSYVDILYHMSSSFPSFVAKRSVARLPMVGLISKCLGCIFVQRESKTSDFKGVSEGTTTNGDYLLPFKTGAFLAKAPVKPVILRYPYKRFSPAWDSMSGARHVFLLLCQFVNNLEVIHLPVYYPSEQEKEDPKLYANNVRKLMAVEGNLILSDLGLAEKRVYHAALNGLLCQS

SEQ ID NO: 6451 - protein, 193 aa, Streptococcus gordonii
INDYSYEEVERIVRKAFDIARGRRKRVTSIDKQNVLATSKLWRRVADEVAKDYPDVTLEHQLVDSAAMLMITNPAKFDVVVTENLFGDILSDESSVLSGTLGVMPSASHSADGPSLYEPIHGSAPDIAGQCIANPISMILSVAMMLRDSFAELEAAEAIEAAVEKTLAQGILTRDLGGQVGTAQMTESIINNL

SEQ ID NO: 6452 - protein, 282 aa, Arabidopsis thaliana
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 6453 - protein, 306 aa, Caulobacter crescentus CB15
MKALSIPDVLAEVAVLVRPHFGKGKPADYIPQLATVPGGKFGMAVRMVDGDEHVIGDADEGFSVQSITKVFALGLALNRLGDEIWTRVGKEPSGTPFNHLSLLEAEQGVPRNPFINAGALAVTDVLMDVTRDPAALVRDFGGFLCGERLEIDPAVATSELAHAWQNRAIASLMRAKGTITHDPEAVVAAYCRQCALSMSCRQLARAFLPLAAGGFSPIAQETVFPERLTRRLNALLLTCGIYDSVGSFAYRVGLPAKSGVGGGIVAVVPGKATVAVWSPELDRFGTSVVGTAALEAFSQITNCSVL

SEQ ID NO: 6454 - protein, 87 aa, Glycine max
DSSMISSPMLPLSTVARAGMYAPFSGLESMAVFPTRMTNNDITSFASYLGILQCMSGCAPDVKKTFDTLSYLPDLDDALLDYEVSIL

SEQ ID NO: 6455 - protein, 292 aa, Burkholderia fungorum
MKLALRKARLVVHLLHGMWTVATRFPKASADVRHTLNREWSLKMLRLCGMRLVVHNDSARLDRGALVVANHISWIDIYVINAWRPTPFVSKAEIRQWPVVGWLAQQLDTVFIQREKRSDAKRIMHELSDRLGAGELMCVFPEGTTSNGLAVLPFHANMFQAAVSASVPVQPLCIMYEDAQGRQSTAPAYIDDLSLADSLNLLLRGGPLTAHVHVGAPLAPGADRRTLAAEAEGVIVAALRQMQSGSAISGAVMAGQAATPAPTATRIEPANQAGQAGQVDEVDQIDQSGRSA

SEQ ID NO: 6456 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFLLMPETLYLAVNIIDRFLSRRSCSLSKFQLTGITALLIASKYEEVMVPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSLKRFLKASIFVHQLVRNDTSVNRTDDDDLQSEPSSSLTNDGH

SEQ ID NO: 6457 - protein, 441 aa, Corynebacterium efficiens YS-314
MPSMTADQIVATSGHAAWMLISASLVLLMTPALALFYGGMSRQKSVLNMMMMSFGTLGVVSVIYVLWGWSMSYGTQSWGGIVANPLEFFGLRNSITDAGGNYLEGASGYANIIDIGFQLTFAVISTALISGALAERVKFSTWLTFTALWSTFVYFPLAHMVWGGGLLAHGETGFAAWLFGVTDGEATIAPIDFAGGTVVHISAGTAALVLALIIGARRTFPMVAARPHNLPLVMLGAALLWFGWFGFNGGSAFAADGLAGLAWLNTTAATAAAILGWLATERLRDGHATSLGAASGVVAGLVTVTPAAGALTPLTALILGVIGGILACLGVGLKYRFGFDDSLDVVGVHLVAGLWGTVGVGLLATDAGWFTGGGMDGFRLFIIQIVIAVVAMIFAAVITAVIAYLLKATMGWRIDEDKEQHGIDTAEHGESAYDTAGPEIR

SEQ ID NO: 6458 - protein, 216 aa, Nicotiana tabacum
MANRVDHEYDYLFKMVLIGDSGVGKSNILSRFTRNEFCLESKSTIGVEFATRTLQVEGKTVKAQIWDTAGQERYRAITSAYYRGAVGALLFYDITKRQTFDNVQRWLRELRDHRDSNIVIILAGNKSDLKHLRAVSEQDDQALVKKEGLSFLETSALEALNVDKAFQTILTDIYHIISKKALAAQEAAASTALPGQGTTINVSDNSANVKRGCCST

SEQ ID NO: 6459 - protein, 147 aa, Oryza sativa (japonica cultivar-group)
MAAAALTSQLNALVNNMFAMGLLDDQFQQLQMLQDSTAPDFVSEVVTLFCDDGERIICELSRQLEKPNVDFDRVDSYVHQLKGSSASVGAQKVKNTCIQFREFCQQRSRDGCLKTLDLVRTEFYDLRNKFQAMLQLEQQIQACYPKH

SEQ ID NO: 6460 - protein, 223 aa, Zea mays
TAVENFQVILDSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQAFIEVAYPYCAACFGRCYPNGATLISERQGTFDAVRQLLTVPARSNSSSIERRQSGGIERRQSGAIERKQSVESTGIAVTDNGLSADGPGLETNSSAATTTSPVDDGPPASK

SEQ ID NO: 6461 - protein, 357 aa, Zea mays
  unsure (1)..(357): unsure at all Xaa locations
PKWVLLTVFCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAAXEGPLKGIMGYAEEDLVFTDFLGDSRSSIFYAKAGIALNDPFVKLVSWFDNEWGYSNRVVDLIPPMFKTQ

SEQ ID NO: 6462 - protein, 441 aa, Chlamydophila pneumoniae CWL029
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 6463 - protein, 295 aa, Zea mays
  unsure (1)..(295): unsure at all Xaa locations
RPNPAPPELRDAGRDILDPAPGEPDFXAPEHIKQAAYAAIAAGATKYTPTPGVKALRVAVQRKLAEENHLDYSLPNIVIANGAKQIIFNAFAATLDDGDQVLVPTPYWPSFPDSVRFNGGEPVFIECGLEQGCKLLPAQLEQHINQRTRWLILNGPGNPSGAVYSEVELQALAEVLRRHPQVLVLLDELYEHIRFDGRPAQSLLNVAPDLQDRCLLVGGVSKTYAMTGWRIGFGAGPQTLTNAMAVVQSQSTSGASSVGQAAALAAFTGGLGFLAEQVAAYQLRRDLLMMALGTG

SEQ ID NO: 6464 - protein, 548 aa, Vibrio vulnificus CMCP6
MTGAELVVAALKQQGIKTVFGYPGGAIMPIYDALYDGGVEHILCRHEQGAAMAAIGMARATQDVAVCMATSGPGATNLVTGLADAFLDSVPLVAITGQVASSHIGTDAFQEMDVIGMSLSCTKHSYLVTDINELAPTLAEAFEVAKTGRPGPVIVDIAKDVQLAKAPVELLPPFTPPALPQVSQVDVARAQTLLDQSTRPVLYVGGGVQLAKATHTVREFLRLNPMPAVSTLKGLGTIERHDPHYLGMLGMHGTKAANLVVQEADLLLVVGARFDDRVTGKLETFAPHAKVIHIDIDAAEINKLRHANAPLRGDINVILPQLELTRDISPWVHHCESLRSGFKWRYDHPGELIYAPGLLKQLSDLMPDNTIVSTDVGQHQMWAAQHIQPREPQNFITSAGLGTMGFGLPAAMGAAVARPDAQSVLISGDGSIMMNIQELGTLKRRQIPVKIVLLNNQRLGMVRQWQSLFFDGRHSETILDDNPDFVMLAKAFDIPGKTITKKEEVEPALKEMLASKTSYLLHVLIDEEENVWPLVPPGASNSDMLENT

SEQ ID NO: 6465 - protein, 196 aa, Neisseria meningitidis MC58
MLLFIDNYDSFTYNIVQYFTELGQEVAVRRNDDITLEEIEALNPQYLVIGPGPCSPKEAGISVAAMRHFAGRLPIMGVCLGHQTIGEAFGGRIVRAKTLMHGKVSPVSHSGKGMFKGLPNPVTCTRYHSLVIDRNTMPECLEVTAWTEDGEIMGVRHKEYAVEGVQFHPEALLTEHGHDMLNNFLIEFQNFKPQKI

SEQ ID NO: 6466 - protein, 259 aa, Oryza sativa
LVGGSWRSIGMGRGRVELKRIENKINRKVTFAKRRNGLLKKAYELSVLCDAEVALIIFSNRGKLYEFCSTQSMTKTLEKYQKCSYAGPETAVQNRESEQLKASRNEYLKLKARVENLQRTQRNLLGPDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 6467 - protein, 334 aa, Geobacillus stearothermophilus
AVKVGINGFGRIGRNVFRAALKNPDIEVVAVNDLTNADGLAHLLKYDSVHGRLDAEVVVNDGDVSVNGKEIIVKAERNPENLAWGEIGVDIVVESTGRFTKREDAAKHLEAGAKKVIISAPAKVENITVVMGVNQDKYDPKAHHVISNASCTTNCLAPFAKVLHQEFGIVRGMMTTVHSYTNNQRILDLPHKDLRGARAAAESIIPTTTGAAKAVALVLPELKGKLNGMAMRVPTPNVSVVDLVAELEKEVTVEEVNAALKAAAEGELKGILAYSEEPLVSRNYNGSTVSSTIDALSTMVIDGKMVKVVSWYDNETGYSHRVVDLAAYINAKGL

SEQ ID NO: 6468 - protein, 443 aa, Rhodospirillum rubrum
AEAAALALNAGVDIDMMATAYSRGLPEALERGLTDMAHIDASVRRVLGLKERLGLFDDPYARCAPRVDAEGDRARRLLARKAASRSVVLLSNPAKILPLPSRLHRLAVVGPLADSRADMRGPWSAAGLPDDPVSVVEGLRDLLPADSIAFAPGIDLMGKDLSGEEAALDLCRAAEAVVLCLGEAATMSGEANCRADPGLPGQQRAFAEKVFDLGVPVIVVLFSGRPLILPWLIERADAVLAAWFPGCEAGPAIAEVLLGLSDPGGRLPVSWPRHVGQVPLFFGARSGGRPENPEDHYTSKYMDMPNTPQFPFGHGLSYGDFALEALTVGPDEVSADGVIEVTVSLINKGGRPGLGCVFLFIHDPVASVARPLLELKGVLRAEVEAGGRCELRWSLPVADLAFLGADLTPRIEAGVIEIAVGRSADPEGLLRRSVRILTPRHQG

SEQ ID NO: 6469 - protein, 256 aa, Triticum aestivum
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 6470 - protein, 268 aa, Xylella fastidiosa Ann-1
MSTSKVVVITGVSSGIGRAAALILAKQGCQVFGTVRNAEKAQAIPGVVLVEMDIRDDVSVERGIQNIIAQAKRIDVLVNNAGVTLLGATEETSVTEAKTLFDTNLFGMLRTIKAVLPHMRGQRSGRIVNISSVLGFLPAPYMALYSASKHAVEGLSETLDHEVRQFGIRVALVEPSFTKTNMDLNAPQTASKIPDYSREFDIVSKAIQKNVQKAPDPEGVASTILNAALGRWKMRRTPKGQASLLAKLRRFMPAGPIEKGLRKTFGLS

SEQ ID NO: 6471 - protein, 314 aa, Scenedesmus vacuolatus
NGFGRIGRNFLRCLETRQNSLLEVIAINDSGGVKQASHLLKYDSTLGKFDADVKIVDDGHISVNGKSIRVVSSRDPTKLPWGEMEIDLVIEGTGVFIDTPGASKHIEAGAKKVLITAPAKGSDIPTYVVGVNAHDYKHSDAIISNASCTTNCLAPFVKVLDEKFGIVKGTMTNTHSYTGDQRLLDASHRDLRRARAAALNIVPTTTGAAKAVALVLPKLKGKLNGIALRVPTPNVSVVDLVVQVEKKTFAEEINNAFKEAAAGSLNGVLAVSDEPLVSVDFRCTDVSSTIDSSLTMVMGADMVKVVAWYDNEWG

SEQ ID NO: 6472 - protein, 324 aa, Zea mays
MAAKGGATPSPGGTGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 6473 - protein, 143 aa, Triticum aestivum
  unsure (1)..(143): unsure at all Xaa locations
MATAAVSVDEKLDKLRAEVAKLDQISENEKSGFISSVSRYLXSGEAEQFEWSKXQDPTDEVVGAYDTVASPPRXLQGDERTAGIXPLCSXLNGGSGTTWGCTGAXLSLEAWILDLWDQIPEQMVNVLDDLNTCDNRRCEINST

SEQ ID NO: 6474 - protein, 703 aa, ASPERGILLUS NIDULANS FGSC A4
MAGQVMADAVHSLLRRAADYDIDPDDGDAPEAGTKEFFSSWALFIMITLLMLALFTSYILQQRKIEAVHETVLSIFGGMFVGLIIRLTDSPITNFVAFDYQFFFNLLLPPIILASGYELHQANFFRNIGTILTFAFAGTFISALVLGLVLFAWTRIPLDGFSISFVEAISVGATLSATDPVTILAIFNLYKVEPKLYTVIFGESILNDAIAIVLFETAQKYAESDAGSLSILNLFEAIGLFLLVFFGSMLVGVIVGIMTALGLKYTHVRRQPKIESCLIVLIAYASYFFSNGVLLSVSGIVSLLFCGITLKHYAYYNMSRRTQLTTKYLFQVMAQLSENFIFIYLGLDLLVQRDVQFKPLFILVAVVGICLARYLAVFPLSKAINWFIRYRARRRGVEVADELPFAYQAMLFWAGLRGAVGVALAAGLKGANGPALRATVLVVVVITVIIFGGTTARMLEILGIRTGVVEELESDDEFDIEVSNGGTYYKRSDTGLGYTPRRADNIPLDGVSRRDLDRNNSYSSGNSRRPSPPSSSRPSRGHSRMYSDAFGPKDTQTPRDRSTTATLLGNRPGSRSDSEDGSENEYGLKSSGKRRALDHDHPDAFELDIDDIHSDDDLPPAAPTRMRRSPSQPPQQSSSSQAPQDSVSPSRREAGRSAREAIRDLFSGGPSGDHVAWFRQLDEDYIKPRLLLDQSNHKGPGAV

SEQ ID NO: 6475 - protein, 648 aa, Xanthium sp.
MAAIPHTNPSITTKPPSSPPRPTFLARFTFPITSTSHKRHRLHISNVLSDSKPTITHSPLPTESFISRYAPDQPRKGADVLVEALEREGVTDVFAYPGGASMEIHQALTRSTTIRNVLPRHEQGGVFAAEGYARASGLPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPIRLPGYLSRLPKTENNGQLEHIVRLVSEAKRPVLYVGGGCLNSGDELRRFVELTGIPVASTLMGLGAYPASSDLSLHMLGMHGTVYANYAVDKSDLLLAFGVRFDDRVTGKLEAFASRAKIVHIDIDSAEIGKNKQPHVSICGDIKVALQGLNKILEVKNSVTNLDFSNWRKELDEQKVKYPLSFKTFGEAIPPQYAIQVLDELTGGNAIISTGVGQHQMWAAQFYKYNKPRQWLTSGGLGAMGFGLPAAIGAAVARPDAVVVDIDGDGSFIMSVQELATIRVENLPVKILLLNNQHLGMVVQLEDRFYKANRAHTYLGNPSKESEIFPNMLKFAEACDIPAARVTRKADLRAAIQKMLDTPGPYLLDVIVPHQEHVLPMIPAGGGFMDVITEGDGRMKY

SEQ ID NO: 6476 - protein, 428 aa, Escherichia coli O157:H7 EDL933
MKIATIKTGLASLAMLPGLVMAAPAVADKADNAFMMICTALVLFMTIPGIALFYGGLIRGKNVLSMLTQVTVTFALVCILWVVYGYSLAFGEGNNFFGNINWLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 6477 - protein, 506 aa, Arabidopsis thaliana
MAGGGLALDVSSAGNIDAKITAAVVMSCIVAASCGLIFGYDIGISGGVTTMKPFLEKFFPSVLKKASEAKTNVYCVYDSQLLTAFTSSLYVAGLVASLVASRLTAAYGRRTTMILGGFTFLFGALINGLAANIAMLISGRILLGFGVGFTNQAAPVYLSEVAPPRWRGAFNIGFSCFISMGVVAANLINYGTDSHRNGWRISLGLAAVPAAIMTVGCLFISDTPSSLLARGKHDEAHTSLLKLRGVENIADVETELAELVRSSQLAIEARAELFMKTILQRRYRPHLVVAVVIPCFQQLTGITVNAFYAPVLFRSVGFGSGPALIATFILGFVNLGSLLLSTMVIDRFGRRFLFIAGGILMLLCQIAVAVLLAVTVGATGDGEMKKGYAVTVVVLLCIYAAGFGWSWGPLSWLVPSEIFPLKIRPAGQSLSVAVNFAATFALSQTFLATLCDFKYGAFLFYGGWIFTMTIFVIMFLPETKGIPVDSMYQVWEKHWYWQRFTKPTST

SEQ ID NO: 6478 - protein, 153 aa, Triticum aestivum
  unsure (1)..(153): unsure at all Xaa locations
MIHPKKLAQLAKKCQRMLVARAGARHWHASDTTGDECCSSVSSVVADEGHCVIYTADGTRFQVPLVYLGTTVFAELLRMSEEEFGFVSSXDGGRIMLTCDASVMEYVLCLVRGEAPEEVERAFLSSIVGHCHNYNARCMAPSMGLGHQFALCT

SEQ ID NO: 6479 - protein, 585 aa, Oryza sativa (japonica cultivar-group); identical to SEQ ID NO: 4009

SEQ ID NO: 6480 - protein, 178 aa, Leuconostoc mesenteroides subsp. mesenteroides
PVVYDPIVAESIEQYNEIYTNPQNAAFLSIDHPENIESSLKSVADGRDIELVVVTDAEGILGMGDWGVNGVDIAVGKLMVYTAAAGIDPATVLPVSIDAGTNNKILLENPLYLGNKHERIAGEKYLEFIDEFVTAEQKLFPASLLHWEDFGRSNAQVILDKYKDSIATFNDDIQGTGI

SEQ ID NO: 6481 - protein, 202 aa, Yersinia kristensenii
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGKTA

SEQ ID NO: 6482 - protein, 177 aa, Lemna gibba
MASSMMASTAAVARAGPAQTNMVAPFNACRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 6483 - protein, 109 aa, Desulfitobacterium hafniense
MFREGGSTAAELLLLAPGAVQIFYGDESSRPFGPTGSDPLQGTRSDMNWQDVSGKAARSVTHWEKLGQFRARHPAIGMGKQTTLSMAKGYGFIRENGDDKVMVVWAGQQ

SEQ ID NO: 6484 - protein, 313 aa, Cyanophora paradoxa
NGFGRIGRLVLRAAVEKGTVEVVAVNDPFIFPDAAYAAYMLQYDSTHGAFPGEVGSDGEHLVVNGKKLACFAIRDPAEIPWGSVGVDYVVEASGAFTAADKASLHLTGGAKKVVLSAPGKDVPMFVMGVNHDAHTKDLKVVSNASCTTNCLAPLAKIIDEAFGIEMGLMSTIHALTATQRRWTGRAPKRLARGRGTFQSIVPTSTGAAKAVGNVYPKLNGKLTGMAFRVPVAAGSVVDLTLNLKRATTYEDIKMVVKEASESQQYNGIVGYTEDSVVSIDIVHNSCSSVFDAGAGIMLSPTFVKLVSWYDNEW

SEQ ID NO: 6485 - protein, 672 aa, Triticum aestivum
  unsure (1)..(672): unsure at all Xaa locations
CDKRYXGYCLLRAMGSMPEGRKCITCIGRPIYEGRRSKLGKSSRILSRLLSSLEVRQILKAEKECQANQLRPEQLIVNGFPLCQEEMSDLLSCPRPPQNLKPGRYWYDKESGLWGKEGEKPNRVVSTNLNFNGKIQPNASNGNTQVYMNGREITSIERKILKFAQVQCPRDTHFWVYDDGRYEEEGQNNIKGKIWESALTRFACALFSLPVPPGDSNGTKDEIPFVPRTVPEYLDQKRIQKLLILGSPGAGTSTIFKQAKLLYGSRFTPEELDNIKLMIQSNMFKYLGILLEGRERFEEEALAIHQTNSEDEDTQQDGNESNGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERNPMSELYGDSHDPSSQAQNKYQLIRVNAKGLNEGCKWVEMFEDVRAVIFSVALSDYDQLGAPASGTSRRLENKMIQSKDLFEATIRHPSFRDTPFVLVLNKFDIFEEEIGRSQFNAFEWISDFSPLRTYDCNQAIDQQAFFYVAMKFKNLYAAHTGDRKLFVWQARARDGPTVDEAFRYLREVLRWEDEKEYGGFCPDESLYKXTPMLSSSRLVEQDWQQHPAADQRQGSTVGCCC

SEQ ID NO: 6486 - protein, 539 aa, Pseudomonas syringae pv. syringae B728a
MKLLAVRRLFRIQRVVIRYRLDDLLFALPLPWWMLALRFVLPWRWLPRRKSELSRGVRFRLALQDLGPIFIKFGQLLSTRRDLLPEDIADELMLLQDRVPPFDQQLAIKLIEEQLGARICDVFSRFDEKPLASASVAQVHAACLKTGEEVVVKVVRPGLKPIIGQDLAWLFILARMAERVSADARLLHPVQVVMDYEKTIYDELDLLREAANASQLRRNFEGSDLLYVPQVYWDWCRPKVLVMERIYGLQVTDMAGLADQRTDMKLLAERGVEIFFTQIFRDSFFHADMHPGNIFVSTVNPWAPKYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPELDLWSTAQPYLERWMRERVSPKTLLGNLQSQVEQLPHIAGMTRDLLERMSRPHASDPPRPWHDRKDEPVLRLIGAALLVGGAIQGWVMSEAATQLLTLTAWPAAIMLIAGLYLIVRR

SEQ ID NO: 6487 - protein, 395 aa, Oryza sativa
MEMRRLLVLFALLSVTAVVPVFLWPDKKGGASDVAVVVAAPPFNASSVTIISWKPRIFFYKGFLSDDECDHLVKLGKEKLKRSMVADNESGKSVMSEVRTSSGMFLDKQQDPVVSGIEERIAAWTLLPQENAENIQILRYENGQKYDPHFDYFQDKVNQLQGGHRYATVLTYLSTVEKGGETVFPNAEPDGTPDPLSLHGSCPVIEGEKWSAPKWIHVRSYDNASSMKQSEECSDLSENCAAWAASGECNNNAVYMIGTEDAPEATRRATAAAAAAAASESESKKKKKKKKKRVRKPRRPPVAAMRRPAGSSSAAALAMAILLGVLVLMALVMDGGEKTGAPAIAAGRRMLVGAADAGQMRTLEDFKADDPFQDSKRRVPNGPDPIHNRNMKLFC

SEQ ID NO: 6488 - protein, 550 aa, Thermobifida fusca
MCRYHRTSGTRARGSTPRPNGHSCLIRRPHHAHPDPTPVLRPACSPPASASGRCSPPHGPIPPGSDLSARSTLRHNEEFPVASLPSVSYSITVRLEIDGRASAVSSLTNAVERVGGAVTALDVNSSGRERLRIDVTCAARDTNHAQAIVEALDAVEGVTVHKVSDRTFLMHLGGKIEMRSKVPLRNRDELSMAYTPGVARVSAAIAANPEDARRLTVKRNSVAVVTDGSAVLGLGNIGPEAALPVMEGKAALFKRFADIDAWPIALDTQDTDEIVRAVQLIAPGFGGINLEDISAPRCFEVEARLRELLDIPVFHDDQHGTAIVVLAALKNALRVVGKELGSVRIAMSGAGAAGTAILKLLLHAGAKDVVVCDVHGAVHQGRGDLDANLRWIAEHTNPDGYAGDLAGAVRGADVFIGVSAPNLLSGEEIAEMNEDAIIFALANPEPEVDPEIAALHAAVVATGRSDYPNQINNVLVFPGFFRGLLDAQSHRVTPDMMLAAASALAAVVTEEELSPHYIIPSVFHPGLAQRVAEAVREVALREGGVERHEN

SEQ ID NO: 6489 - protein, 112 aa, Pyrococcus furiosus DSM 3638
MAEDIEEIRRRKLMELQKKYLEQQKAQEEAERQQALIEAQIQAILRRILTPEARERLARVKLVKPELARQVELILVQLYQAGQITEKIDDAKMKKILAQIEARTRREFRIKW

SEQ ID NO: 6490 - protein, 364 aa, Burkholderia fungorum
MKTYRIATIPGDGIGKEVIPAGAQVLEALARTSKSFAFEFENFGWGGDYYREHGVMMPADGLDAIRNKDAILFGSAGDPDIPDHITLWGLRLKICQGFDQYANVRPTRILPGIDGPLKRCKPGDLNWVIVRENSEGEYSGVGGRVHQGHPIEAATDVSILTRAGVERIMRFAFRLAQSRPRKLLTVITKSNAQRHAMVLWDEIALEISKEFPDVKWDKELVDASTARMINRPATLDTIVATNLHADILSDLAAALAGSLGIAPTGNIDPERRYPSMFEPIHGSAFDIMGKGLANPVGTFWSVVMLLEHLGEFDAAQRVMQAVEAVTADTSLHTGDLGGTATTAQVTAAVCAFIENAVSSAARAA

SEQ ID NO: 6491 - protein, 293 aa, Chloroflexus aurantiacus
MEKSTWTTKVGLAQMLKGGVIMDVVTPEQARIAEEAGAVAVMALERVPADIRAQGGVARMSDPELILAIKQAVTIPVMAKARIGHFVEAQVLEAIGVDYIDESEVLTPADEEHHINKHKFRVPFVCGCRNLGEALRRVAEGAAMLRTKGEAGTGNVVEAVRHARAVYSEIRRLQSMNEDELFTYAKQIQAPYELVKQVATEGKLPVVNFAAGGIATPADAALLMQLGVDGIFVGSGIFKSGDPVKRARAIVEATTHYNDPEIIAEVSKGLGEAMVGINIDQIPADQLMARRGW

SEQ ID NO: 6492 - protein, 185 aa, Vitis vinifera
NPPSYRDANKVYAKCLRGVADKLLSRLSVGLGLGEKELRESVGGDELTYLLKINYYPPCPRPDLALGVVAHTDMSAIAILVPNHVQGLQLFRDDHWFDVKYIPNALVIHIGDQLEILSNGKYKSVLHRTTVNKDMTRMSWPVFLEPPPELAIGPLPKLTSEDNPPKYKKKRYCDYVYCKLNKIPQ

SEQ ID NO: 6493 - protein, 245 aa, Oryza sativa (japonica cultivar-group); identical to SEQ ID NO: 5606

SEQ ID NO: 6494 - protein, 166 aa, Lycopersicon esculentum
SFNGEEIYAPFKSILPMVNPDDVVFGGWDISNMNLADAMARAKVFDIDLQMQLRPYMESMVPLPGIYDPDFIAANQGSRANNVIKGTKKEQIDQIIKDIREFKENNKVDRVVVLWTANTERYSSVAVGFNDTMENLFASVDRNEAEISPSTLYAIACILENVPFIN

SEQ ID NO: 6495 - protein, 600 aa, Glycine max
MWKVVRFAAARSRRFSTAIPGPCKVHKRGTDILHDPWFNKDTGFPLTERDRLGLRGLLPPRVISFEHQYDRFMNSYRSLEKNTQGQSDRFVSLSKWRILNRLHDRNETLYYRVLIDNIKEFAPIIYTPTVGLVCENYSGLFRRPRGMYFSAKDKGEMMSMIYNWPSDQVDMIVLTDGSRILGLGDLGVQGIGIPIGKLDMYVAAAGINPQKILPVMLDVGTNNQKLLEDPLYLGVRQPRLEGEEYLLIVDEFMEAVHARWPKAIVQFEDFQMKWAFETLKRYRERFCMFNDDIQGTAGVALAGLLGTVRSQGQPLSDFLKQKIVVVGAGSAGLGVLSMAVQAVSRMSGGSGTDANSQFFLIDKDGLVTTERSNLDPAAVPFAKNPRDLEGLSEGASIIEVVKKVKPHVLLGLSGVGGVFNTEVLKAMRESVSTKPAIFAMSNPTMNAECTAIEAFSHAGENIVFASGSPFENVDLGNGEVGHVNQANNMYLFPGIGLGTLLSGARHITDGMLRAAAECLASYMTEDDVRKGILYPSIDCIRDVTAEVGAAVVCAAVAEKQAEGHGDVGFKELENMSKEETVEYVRGNMWYPEYCPLVHEK

SEQ ID NO: 6496 - protein, 337 aa, Zymomonas mobilis
MAVKVAINGFGRIGRLAARAILSRPDSGLELVTINDLGSVEGNAFLFKRDSAHGTYPGTVTTEGNDMVIDGKKIVVTAERDPANLPHKKLGVDIVMECTGIFTNTEKASAHLTAGAKKVLISAPAKGDVDRTVVYGVNHKDLTADDKIVSNASCTTNCLAPVLHVLQQKIGIVRGLMTTVHSFTNDQRILDQIHSDLRRARTASASMIPTSTGAARAVALVIPELKGKLDGISIRVPTPDVSLVDFTFVPQRDTTAEEINSVLKAAADTGDMTGVLGYTDEPLVSRDFYSDPHSSTVDSRETAVLEGKLARVVAWYDNEWGFSNRMVDTAAQMAKTL

SEQ ID NO: 6497 - protein, 561 aa, GIBBERELLA ZEAE PH-1
MAGRTGSIHGLTGKALIIFVSLGVFLFGYDQGVMSGIITGPYFIDYFGHPSKAYVGTMVAILEIGAFITSLMVGRIGDIIGRRRTIFYGSCVFFIGGALQTLATSMPMMMAGRFVAGFGVGALSTIVPVYQSEISPPHNRGKLACIEFTGNIVGYATSVWVDYGCGYIENDYSWRIPLGLQCIMGALLGLGSLVIVESPRWLLDNDHDEEGMVVIANLYGGGDIHDPKARDEYREIKMNVLLQRQEGERTYKDMFRRYKTRVFIAMSAQALAQLNGINVISYYAPYVFESAGWVGHDAVLMTGFNSLTYLMSTIPPWYLVDRWGRRKILLSGATAMAISLSLISYFLFLDIKWTPRLVVLFVMIYNAAFGYSWGPIPWLYPPEILPLSIRSKGASLSTATNWAANWLVGEMTPILQEWIKWRMYLVHAFFCVVSVVVVYFIYPETCGVRLEDMDSLFGDASTVAGTPSLHGTETGSLIRGGSPVGSSRGLIGPSSAIPGLSLDPPTVDDDNKSQMQSGADERSVGGWLSRVVGRNRSDSGSSAQGRYAPLGQQEEGRRNDR

SEQ ID NO: 6498 - protein, 478 aa, Oenococcus oeni MCW
MDIFRKKDVGEILKHSTPLKRTLRTWDLTFLGIGAIIGTGIFVLTGKGALTAGPAISVSFLVAAICCGFAGLCYAEFASMAPVAGSAYTYSYIAFGEIIAFIIGWDLILEYTLGAATVSVGWSGYFANLLGNLGIHIPTVLTAAAGTTAGVTSYFNLPAFLIVLLITWIISIGITQTKRANDTMVIVKLAVILLFIVCTIWFIKPHNWQPFSPYGLYSFHNGTAAGIIPAASIVFFSFIGFDSVSSSAEETINPSKTLPRGILLSLFISTVLYIIMTLIMTGVVKFTVFAKYLNAPVLAVLHSTGQTWLSIIVSIGAILGITTVILVQLYGQSRISYSMSRDGLFPKFFGDVNMKYQTPFKGTWFFGIITAIAGGLINLNILAELVNIGTLTAFILVSAGVLWMRHSHPEVHRGFKAPGVPFTPIIAIIFCLVLIAGLNWETWIRFIVWFAIGMILYFGYAKKHSKLNSFKPQDKGAD

SEQ ID NO: 6499 - protein, 487 aa, Oryza sativa
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 6500 - protein, 361 aa, Oryza sativa
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAPDVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 6501 - protein, 433 aa, Thinopyrum elongatum
MQCFRFASWEKEREEELQGPARSQSALSNSSMSTDRDARRSGSECCSLTVSSEISVDSFGRYRQLSLPHRPNNDLRIFTFQELKSATRSFSRALMIGEGGFGCVYRGTIQSTLEPRRSLDVAIKQLGRKGLQGHKEWVTEVNFLGVVDHPNLVKLIGYCAEDDERGIQLLLVYEFMPHGSLADHLSTRSPKPASWAMRLRVALDTARGLKYLHEDSEFKIIFRDLKPSNILLDENWNAKLSDFGLARLGPQEGSHVSTAVVGTIGYAAPEYIHTGRLSSKNDIWSYGVVLYELLTGRRPLDRNRPRGEQNLVEWVKPYSSDTKKFETIMDPRLEGNYNLKSAARIASLANKCLVRHARYRPKMSEVLEMVQKIVDSSDLGTPERPLISHSKKLASDEKKRKGLNLKRRIADIKAGDGRWFRWHKWTPKLVRTQ

SEQ ID NO: 6502 - protein, 317 aa, Bradyrhizobium japonicum USDA 110
MSSPQAIPSAGRPLSAGAIALMLMLCLTWGFNQIAVKLVLPDIPPMLQAMIRSMGALPVLFIIGTLRGVKFFEKDGTWKPGLIAGLMFGIEFVLIFQGLRLTPASRAVVFLYTAPFFVALGSYQVLGERLGGTQWLGLAVSFAGVALAIGVPQPDVDAKVLLGDLMIVGGAALWAATTLVAKGTRLRFAAPEKALGYQVATSIPILGLAAWLFGESITHTPAPLSLALMAFQAIWVVGTTFTLWFALVKAYSASKLSAFTFITPLFGVVGSYFIMHDTLSLTFGAAAVLVIAGLFLVNRPSQTAAAPRDALLNVTKT

SEQ ID NO: 6503 - protein, 261 aa, Thermobifida fusca
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 6504 - protein, 1017 aa, GIBBERELLA ZEAE PH-1
MASHGQYPPAHMLANKHHHAPYGSAPVVVPGVAPAGTFAPGTKIQVGSHRVVIQKYLSEGGFAHVYLVKLAKPVDGTDQAVLKRVAVPDKDTLRGMRTEVETMKRLKGHRPIVTYIDSHASELQGGGYEVFLLMEFCDGGGLIDFMNTRLQHRLTEPEILNIFTDIAEGLACMHYLKPPLLHRDIKVENVLITARGTSKRFKLCDFGSAASPQPAPTTVTECRLVDEDIQKHTTMQYRSPEMIDVYRKQPINEKSDIWALGVLLYKLCYYTTPFEDQGQLAILNASYRFPSHPVFSDRLKKLIASMLRENLQDRPNVYQVLKEGCAMQGRDVPVHDIYSGRSQPHARTDSPHHMAQKPDQAPAVGAVFERVEPKKQVIPDVVPMRRGRPAASPAPGNVSQKPEASPMRKAGGDPFAALDAKAASKGIDELSSRFPTLDQFSLLHDQGSKFDFDVSSPISPVNASSDLNDRVTAKLAEEAFATPPTDSPRLKPVSRTHSVTPVGHKAALGSPPLEPSLTKTLSAPSRPDISRAQSIISNNPELQAISSQSSSRYVSTGTMTSTPPPERFGQEVEQPVRHDAHDHARASSATRQPEQSAGQWTAEESRPSFMQRIPSYQQPGHEHQPSSSRPSLEGGRPRIDLLDPSARASPAPSAQSALSRPRPASTNLEGTTLDFLREREAASRSSSRPPRGSSPYQEPADEPRASSDMDFLRSLEDSERAKAGKRSSLTSLSGNKNILAGKFGDAFKLFEGSSPNNGRVPSPERESHRDLTPIAGSEATDGRSDDGHVHEDEDRVTPEMRREMERLKLLEEEQRVEAAQAEYRKRVAAGQRGPPVPPKSIGGVSRAVSIQNRVQSLLSEEQKPANVQRTAQGYGKYTDTPEPGDKSEKPLPGVPKKPLNVTKTRGDASQALSPSSTASAPAALASKPPMKPPAPKKPVHLNSIPTGQRPVSPQKPTRAQTASEDLISMDSPGRQVLEMTAQEKDDYLQDFSKRFPDLGSIEMVEREIGGQNGGSSR

SEQ ID NO: 6505 - protein, 168 aa, Prochlorococcus marinus str. MIT 9313
MPITALLLSRRSLLIATIAGAFGVYRRPAAAFAATRAEDLDWSLSNEQWAKCLSPEAYRVLREEGTERPFTSSLNKEKRVGIYHCAGCDLPLFSSAAKFDSGTGWPSFWEPLAGAIQTKVDFKLIIPRSEYHCRRCGGHQGHVFNDGPRPTGKRYCNNGVALTFRPAR

SEQ ID NO: 6506 - protein, 336 aa, Trichodesmium erythraeum IMS101
MQLKLTNSKLPLAPLLLIAPFFFWGTAMVAMKGVIPQTTPFFMAAIRILPAGILLLLIGMLQGRPQPQNKLAWLWILLFALIDGALFQGFLAQGLVKTGAGLGSVMIDSQPLAVAILSLWLFQERIRFWGWLGLGIGVFGISLIGLPDEWISSLLHPETIQISLGMDTFSQSGEWLMLLASLSMAVGTVLVRWVCKYNDPVMATGWHLILGGIPLLAISAGVESQQWVNIDQYGWIAMGYAAVFGSAIAYGLFFYFASSGNLTSLSALTFLTPIFALLFGNLFLGEILSRLQSIGVGLTLVSIYLINQRDVLAERLNFSSSRQEVFSNITTRNLLK

SEQ ID NO: 6507 - protein, 513 aa, Magnetospirillum magnetotacticum
MIRSIRNLNRLLTIGRVLARHDALFLLEDYLPMVRFGSRLLRGGRSPVSTGRPGQRLAAALAELGPSFIKLGQALSTRADLLGEEMAADLSGLQDELPPFAAEEARRIIEEELGGPLSNFYSEFDDVPVAAASIAQVHFATTRQGREVAVKVLRPGVEAKFHRDIDLLYWLSEWAELTIPRIRRLKPVETVKTFEESVTLEMDLRFEAAAASELAENFRGDDNFKVPEVDWLRTGKRLLTLERVAGIPVDETERLRAAGIDPVDVLAKAAEAMFNQVFRDGFFHADMHPGNLFIGEGGQLIAMDFGIMGRVDKRTRRFLGEMLLGFLSGDYRKVAEVHFAAGYVPADQSLDTFTQACRSIAEPILGRPLHEISIAKLLGQLFQVTETFAMETQPQLLLLQKSMLVAEGVGRILDPNINMWHLAQPLIEGWMRENLGPEAKIRETLGSVVGSLERLPRLLAETEKTYSMLVNQGLKLHPDTVKAMFPEGGRLRRPSPLLAWIIAAGLAVALYLK

SEQ ID NO: 6508 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 6509 - protein, 72 aa, Glycine max
SSSQVLRTRNRAGAGMGAPFTGLKSMAGLKTRKTNDDITYIASNGCRVQCMHETTPIGMKNLETLDYLPDDL

SEQ ID NO: 6510 - protein, 626 aa, Rhizobium leguminosarum
MRKERLREDPMGKTIRLTMAQAVAHFLKVQMTIVDGKKVPIFGGVWAIFGHGNVAGIGEALYQVREELTTYRAHNEQGMAHAAIAYAKANFRTRFMACTSSIGPGALNMVTAAGVAHVNRIPVLFLPGDVFANRAPDPVLQQIEDSATASVSANDAFRSVSRYFDRITRPEQIITALKRAMQVLTDPLDCGPVTLSLCQDVQAEAYDYPESLFAEKVWTTRRPQPDADELANAIALIKASQKPVIVAGGGVLYSQATKELAAFAEAHGIPVVVSQAGKSAINETHPLALGSVGVTGTSAANAIAEETDLVIAVGTRCQDFTTGSWALFKNDSLKMIGLNIAAYDAVKHDSHPLVADAREGLKALSAGLSGWKAPAALAEKAAAEKKIWMEAAARAMATTNAALPSDAQVIGAVARTIGGENTTVLCAAGGLPGELHKLWPATAPGSYHMEYGFSCMGYEIAGGLGAKMARPERDVVVMVGDGSYMMMNSELATSVMLGLKLNIIVLDNRGYGCINRLQMGTGGANFNNLLKDSYHEVMPEIDFRAHAESMGAIAVKVASIAELEQALADSRKNDRTSVFVIDTDPLITTEAGGHWWDVAVPEVSSRSEVNRAHEAYVKARAAQRVG

SEQ ID NO: 6511 - protein, 480 aa, Cryptopleura lobulifera
GRLKNERYESGVIPYAKMGYWDPNYVIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIKGFYDTLLLPYLEVNLPQGIFFKQDWASLRKVTPVASGGIHCGQMHQLLDYLGNDVVLQFGGGTIGHPDGIQAGATANRVALESMVIARNEGIDYVAEGPQILRDAAKTCGPLQTALDLWKDITFNYTSTDTADFVETPTANV

SEQ ID NO: 6512 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 6513 - protein, 186 aa, Arabidopsis thaliana
YPYIAGMGIYVVSRDVMLDLLRNQFPGANDFGSEVIPGAPFLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDINARIG

SEQ ID NO: 6514 - protein, 204 aa, Zea mays
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSSLATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 6515 - protein, 468 aa, Saccorhiza dermatodea
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLSFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVATESN

SEQ ID NO: 6516 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 6517 - protein, 503 aa, Triticum aestivum
  unsure (1)..(503): unsure at all Xaa locations
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEXGDMQLXAEAYRRSSKSVGKLTNGELQPVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGWSLPHPHRTTTLLLPPRTHARRTSSRPRQAGSYQKGPCRAGRPGLAPSGQHPGHKLPDHWLPHPDLQGRCARPERNVTGHPSPRKPPSLRFPRTLHPYATLRQRTCRPPARQSSSTLGRGPGHVRRGECIVGRN

SEQ ID NO: 6518 - protein, 189 aa, Glycine max
LGGKAPFVFAPPCLVSLLGALLFLGSGLLAVGPPRIGFNVVIVGKFPSFPPVAPLPRCLPRAPLVPRGSPVAEALAKRGPMGAPLMRAFVGLAPGLTIIFGARVGRGPKNNMVGGAQLSVFFYYFFCLVFCRGAPPPPFLCCFWAGRFLFPGLLFGWGPGLGKKKKKKKKKKKKKKTPKKKKKKNPKNP

SEQ ID NO: 6519 - protein, 142 aa, Yersinia bercovieri
MVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVV

SEQ ID NO: 6520 - protein, 385 aa, Escherichia coli
  unsure (1)..(385): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGINPCSEEXXXXXVRAAIEYAIATDRDSVTLVXKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEG

SEQ ID NO: 6521 - protein, 722 aa, ASPERGILLUS NIDULANS FGSC A4
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 6522 - protein, 486 aa, Corynebacterium glutamicum ATCC 13032
MEQDLSYREILPLNASEEKKKAALIDAIEGLRVRDPLLSASIAFTRGQKVAFIAVVVGFILMLIFARQAALIGLSATCTFMYLITLLDRFIMFSRGIRAESIIQVSDEDALAFPEDKLKTYTVLVPAYGEPEVIAQLLASMHAFDYPKHLLQVLLMLEEDDLPTIAAAEAAGVDQVATIIKVPPAQPRTKPKACNYGLHFATGEIVTIFDAEDMPDPLQLRRVVVAFERSASNTVCVQSRLSYRNARQNLLTAWFTIEYDVWFNFLLPGVMRMNAPVPLGGTSNHLLTGVLKDLGAWDPFNVTEDADLGVRIAAKGYSTAVLDSVTWEEANSDTINWLRQRSRWYKGYLQTWLVYMRRPKWLVQELGIIPAVRFTFLMAGTPIIAVLNLLFWYLSLTWILGQPGTIEQMFPPAVYYPALVCLVVGNAATIFMNLIGCREGRDPLLLIAVLTFPLYWLLMSIAALKGTWQLITRPSYWEKTAHGLEA

SEQ ID NO: 6523 - protein, 375 aa, Streptomyces coelicolor A3(2)
MTGFLLPNARLTPQEHPGAATSALPPVTVLVPFYRETAAILRRSADMLRSLDYPHDRLSVCWLVDARYPEDVAAAENVAASARADFGGGLRVVPVPSMTPKAKALNHALRSVDDPFVALYDADTVPDPRQLRQAVAALDARGLDVVDAIELPEAGGDLVNRITLAQSAAFFGAMEYVNRRTGMHMLLGSSIYFRRTALSKVGPLSEDGVEELYEWAVRAAAAGVRMGRIVSFSYGTRTSVVGPALRQRTRWIRGQLDIGVRFLGGKPLPARPRTAVALMTLSLLGQLGVLPVTAAAVRYRALRLPAAALLLGEALRVRSVSRDPVWEVLRIGSGWALLLPFELLESTSAWRAVWELATGRDTWHKVRPETGERTT

SEQ ID NO: 6524 - protein, 398 aa, Solanum tuberosum
MATEEDAVRRRTALADYRKKLLQHKELDARVRTVRENLRATKKEYAKTEDDLKSLQSVGQIIGEVLRPLDNERLIVKASSGPRYVVGCRSKVDKEKLTSGTRVVLDMTTLTIMRALPREVDPVVYNMLHEDPGNISYSAVGGLSDQIRELRESIELPLMNPELFLRVGIKPPKGVLLYGPPGTGKTLLARAIASNIDANFLKVVSSAIIDKYIGESARLIREMFNYARDHQPCIIFMDEIDAIGGRRFSEGTSADREIQRTLMELLNQLDGFDQLGKVKMIMATNRPDVLDPALLRPGRLDRKIEIPLPNEQSRMEILKIHAAGIAKHGEIDYEAAIKLAEGFNGADMRNVCTEAGMFAIRAERDYVIHEDFMKAVRKLNEAKKLESSAHYSADFGKE

SEQ ID NO: 6525 - protein, 422 aa, Zea mays
  unsure (1)..(422): unsure at all Xaa locations
MRRVRVSSHQAPVHKLGDGQMKLTPRFRLAATPAPPGPDSYPDPDPQQASWEAAEALIPGLPDDAGAXCLLRLAVESHGACRLVCRRWRHLLADKARFFAQRRALGLRAPWLFTLAFHRCTGEIQWKVLDLGQRSWHAIPAMPCRDRACPRGFGCVAVPAAGNGDGGGGGDALVVCGGLVSDMDCPLHLVLRYDVCRNRWAVMARMLAARSFFAGGVIDGRVYVAGGYSADQFELSSAEVLDPAGAGAWRPVASMGANMASADSAVLGGRLYVTEGCAWPFFSAPRGQVYDPRADRWEAMPAGMREGWTGLSVVVAGRLFVVSEYERMKVKVYDPETDSWDAVGGAPMPERIMKPFSVSCVDSRIVVVGRGLHVAIGHVREEPAGGGPGSRGAPGYSVCWQDVDAPKEFSDLTPSSSQILHA

SEQ ID NO: 6526 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 6527 - protein, 203 aa, Triticum aestivum
  unsure (1)..(203): unsure at all Xaa locations
MSATCAADLAPLLGAAAMNATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAIAAAGITSGSIAERTQFVAYLIYSAFLTGFVYPVVSHWIWSVDGWAXAARTSGPLLFKSGVIDFAGSGVVHMVG

SEQ ID NO: 6528 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPSEAMDINLFKLTLDEIREKGIKQMPHTLRRSLEEMLADKQYLKEGQ

SEQ ID NO: 6529 - protein, 472 aa, Hymenena multipartita
  unsure (1)..(472): unsure at all Xaa locations
ESGVIPYAKMGYWDPNYVIKETDVLALFRVSPQPGVDPVEASAAVAGESSTATWTVXXXXXXXXXXXXXXXXXXXXXXXXXTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIVMIDLVIGYTAIQTMAIWARRNDMILHLHRAGNSTYSRQKIHGMNFRVICKWMRMAGVDHIHAGTVVGKLEGDPLMIKGFYDTLLLPYLDINLPLGIFFTQDWASLRKVTPVASGGIHCGQMHQLLDYLGDDVVLQFGGGTIGHPDGIQAGATANRVALESMVIARNEGVDYVTEGPQILRDAAKTCGPLQTALDLWKDITFNYTSTDTADFVETPTPNV

SEQ ID NO: 6530 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 6531 - protein, 662 aa, GIBBERELLA ZEAE PH-1
MFKLTKVRSSRVYRFCSSPLLPMRSLNNNYATQAEKSQSTTTKNKSNSKYENLPLSTSGPINCALSGTSLLNTPYLNKGSAFPPDERRAFNLTGLLPQGVQTLEQQCKRAYEQYSSRPDDLAKNTFLTSLKDQNEVLYYKASYLPACHEGITDCQIQLIQTHLDEMMSIVYTPTEGDAIQNYSRLFRRPEGCYLNIQDPDHVEHNLAQWGNPEDIDYIVVSDGEEILGIGDQGVGGILISVAKLVLTTLCAGVHPNRTLPVVLDCGTDNKELLEDELYLGLKEKRVRGEEYAKFVDTFVQSARKLYPNAYIHFEDFGLGNARKILERYRPDFACFNDDVQGTGCVTLAAILSGLHASDQKLKDLRMVVFGSGSAGLGIADQVRDAIATEGNMSHEDAANQIWLIDKSGLLTSETEDVTESQKMYIKDVSEWKDKDADLLSVVKEIRPNVLVGTSTKAGAFTEDVIRAMTEHHERPIVLPLSNPTRLHEAKPEDILNWTDGKALVATGSPFPAVKGPWGKNGEEITINVGECNNSVVFPGIGLGCILSRAKHLTDRMLVAAVEGVSSLSPVLKDSTAPLLPDVGSVRDVSVRIARNVIQAAVKDGEATQEGIPEDEEDLEEWIKEQMWDPEYRPLKQVDLESATREARGELKKAGTVHRTGHT

SEQ ID NO: 6532 - protein, 446 aa, Enterococcus faecium
MVKKQITGEEIKRIIEEENVRFLRLMFTDILGTIKNVEVPVSQIDKVLENKMMFDGSSIEGFVRIEESDMYLYPDLSTWMIFPWESAHGKVARLICDIYNPDGTPFAGDPRGNLKRALKDMRDLGFTSFNLGPEPEFFLFKLDEDGGITTTLNDKGGYFDFAPTDLGENCRRDIVLELESLGFEVEASHHEVAPGQHEIDFKYADVVDACDNIQTFKLVVKTIARKHGLHATFMPKPLFGINGSGMHCNMSLFNDEGNVFYDKDGELELSETAYHFLGGLLKHARAYTAVCNPTVNSYKRLVPGYEAPVYVAWSGRNRSPLVRVPESRGLSTRLELRSVDPSANPYLAMAVLLQAGLDGIRNQITPPAAVDRNIYVMDEEEREAAHIQDLPSTIHNAIKELRKDNVMIDALGQHIFSNFVEAKRLEWAAFRQTVSEWEREQYLELY

SEQ ID NO: 6533 - protein, 328 aa, Lycopersicon esculentum
MAVNGASSSGLIVSFGEMLIDFVPTVSGVSLAEAPGFLKAPGGAPANVAIAVTRLGGKSAFVGKLGDDEFGHMLAGILKTNGVQAEGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKGGA

SEQ ID NO: 6534 - protein, 329 aa, Nostoc punctiforme
MGKKYDVYGVGNALVDIEYEVSPELLQELKIDKGVMTLLDEDSQNHILENLKNLHCHKSCGGSAANTMVAISQLGGKAFYSCKVANDEFGDFYIEDLLNSQVDTNLKNGDRQSGITGKCLVLVTPDADRTMNTFLGITEKFSTQELVSSALADSEYIYIEGYLVTSPTAKEAAIKAREIAEKAGVKTAMSLSDYNMVKFFKDGLLDIIGPGLDLIFANESEALELADTQDFQVAVDKLKTLSKKFAITRGSKGSVVFDGQELIEIAAPQVKAIDTVGAGDMYAGAFLYGITQSMSYEEAGKLASTAASKIVTSYGPRLKTEELKALVSA

SEQ ID NO: 6535 - protein, 177 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGASSVKCAICCYITNISMTNGRLSIPVQRPNGTTNSGTLPSTSTSMPQSQSQTVVVENPMSVDSSGKLVSNVVVGVTTDKK

SEQ ID NO: 6536 - protein, 512 aa, Ceratopteris richardii
MDYDGHMRASMSSNICNVMNYAEGQVGSMVALMTTDHGTEGEQNRNHNPQHTSQHEQPQNQSSHSRNDRRQQLRSLNQTTMSSSLPTSSLTYYNAAMVEPYLQSALLQSTHTFNQSNNVETHPHIISALDQLETSVVVSAEEEKPHIGIRPKPVQSAQFPSSIDCNYVLSSSGQSVLVSPGANSTTHESQAAVASVSRDMENAHASADRSDVIRSKIMSHPTYPRLVMAYVNCHKIGAPPEVATSLEEISKKYQSFRSSSPAPTGADPELDNFMETYCNVLQKYHDELMQPYKEAMTFFRKIELQLNALSKGTVRLCHTGDDKADANCNSGQHGLISGGSSGEEDAEEGDVSCGEVDFHEEMIDPLADDQKVKEQLLRKYSGYIYKLKQEFLKKKKKGKLPKNAREKLLDWWNQHYKWPYPSEAEKAALAETTGLDQKQINNWFINQRKRHWKPSEDMQYVMVDSPTAHHHHHVLHGHAHLTPHPLAPYAVMETMDAAAAAAAAVTMLPSLQ

SEQ ID NO: 6537 - protein, 477 aa, Hymenena curdieana
KNERYESGVIPYAKMGYWDPDYVIKETDVLALFRVSPQPGVDPVEASAAVAGESSTATWTVVWTDLLTACDLYRAKAYKVDAVPNTTDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSIEAVNRSIAATGEVKGHYMNVTSANMEDMYERAEFAKQLGSIIIMVDLVIGYTAIQTMAIWSRKNDMILHLHRAGNSTYSRQKIHGMNFRVICKWMRMAGVDHIHAGTVVGKLEGDPLMIKGFYDTLLLPYLDMNLPLGLFFTQDWASLRKVTPVASGGIHCGQMHQLLDYLGNDVVLQFGGGTIGHPDGIQAGATANRVALESMVIARNEGIDYVAEGPQILRDAAKTCGPLQTALDLWKDITFNYTSTDTADFVETPTANV

SEQ ID NO: 6538 - protein, 396 aa, Persea americana
MALKLSPVMFQSQKLPFLASYPPSNLRSPRVFMASTLRSSTKEVDNIKKPFSPPREVHVQVTHSMPPQKIEIFKSLEDWAEENILVHLKPVEKCWQPQDFLPEPESEGFLESVEELRKRAKEIPDEYFVCLVGDMITEEALPTYQTMLNTLDGVRDETGASPTSWAIWTRAWTAEENRHGDLLNKYLYLSGRVDMRQIEKTIQYLIGSGMDPRTENSPYLGFVYTSFQERATFISHGNTARHAKEYGDDKLAKICGTIAADEKRHETAYTKIVEKLFEIDPDGTVLAFCDMMKKKISMPAHLMYDGQDDDLFGHFSSVAQRLGVYTAKDYADILEFLVRRWDVEHLTGLSPEGKTAQEFICKLAPRIRSLEERARSRAKEGPTIPFSWIFNREVKL

SEQ ID NO: 6539 - protein, 556 aa, Zymobacter palmae
MYTVGMYLAERLAQIGLKHHFAVAGDYNLVLLDQLLLNKDMEQVYCCNELNCGFSAEGYARARGAAAAIVTFSVGAISAMNAIGGAYAENLPVILISGSPNTNDYGTGHILHHTIGTTDYNYQLEMVKHVTCARESIVSAEEAPAKIDHVIRTALRERKPAYLEIACNVAGAECVRPGPINSLLRELEVDQTSVTAAVDAAVEWLQDRQNVVMLVGSKLRAAAAEKQAVALADRLGCAVTIMAAEKGFFPEDHPNFRGLYWGEVSSEGAQELVENADAILCLAPVFNDYATVGWNSWPKGDNVMVMDTDRVTFAGQSFEGLSLSTFAAALAEKAPSRPATTQGTQAPVLGIEAAEPNAPLTNDEMTRQIQSLITSDTTLTAETGDSWFNASRMPIPGGARVELEMQWGHIGWSVPSAFGNAVGSPERRHIMMVGDGSFQLTAQEVAQMIRYEIPVIIFLINNRGYVIEIAIHDGPYNYIKNWNYAGLIDVFNDEDGHGLGLKASTGAELEGAIKKALDNRRGPTLIECNIAQDDCTETLIAWGKRVAATNSRKPQA

SEQ ID NO: 6540 - protein, 513 aa, Zea mays
  unsure (1)..(513): unsure at all Xaa locations
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMXVNPDDLVFGGWDISSMNLADAMTRAKVLDIDLQKQLRPYMESMVPLPGVYDPDFIAANQGXSRANNVIKGTXKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPXILDLVLLAELSTRIQLKPEGTDKFHSFHPVATILSYLTKAPLVPPGTPVVNALAKQRAMLENIMRACVGLAPENNMILEYK

SEQ ID NO: 6541 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 6542 - protein, 143 aa, Cichorium intybus
MAREKIKIRKIDNITARQVTFSKRRRGLLKKAEELAVLCDADVALVIFSATGKLFEYASSSMQELLGKYKLHSTNNVNKVDEPSLDLQLVESQESRMSQEVLEKDRELSQLRGEDLQGLTLEELQRLESLLEGRLNRVAPDKG

SEQ ID NO: 6543 - protein, 616 aa, Oryza sativa
MASSKETYRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKNLERMEVEERQAQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 6544 - protein, 154 aa, Pectobacterium carotovorum subsp. carotovorum
LRRKPGMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQVPG

SEQ ID NO: 6545 - protein, 264 aa, Zea mays
  unsure (1)..(264): unsure at all Xaa locations
MSRRYDSRTTIFSPEGRLYQVEYAMEAIGNAGSALGILAADGVVLVGEKKVTSKLLQSSRSAEKMYKIDSHLACAVAGIMSDANILINTARLHAQRYALSYQEPIPVEQLVQSLCDTKQGYTQFGGLRPFGVSFLFAGWDKNHGFQLYMSDPSGNYGGWKAAAVGANSQAAQSMLKQDYKDGMTREEAVALALKVLSKTMDSTSLTADKLELAEVFVQPGTGXKVQYQVGSPDAMGEAAWQGLGSTPPAPEGLMVLGLVWFWDA

SEQ ID NO: 6546 - protein, 194 aa, Triticum aestivum
  unsure (1)..(194): unsure at all Xaa locations
ATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDAXQVINEVEEXKKEYLTLFRIIGFKTCSAMLTYRLKPRAARSGKATHHKGIKMHVTRMLGSSNYFYVQFFMFNCQNL

SEQ ID NO: 6547 - protein, 179 aa, Glycine max
  unsure (1)..(179): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPKYYDRRYXNHXKLPIFNYTNTSQVLKELQQAKTTYPNHFIHIIKFDNXVRQVHYIIFITYKPPSF

SEQ ID NO: 6548 - protein, 135 aa, Zea mays
MASADARLAGIASSIRVIPDFPKPGIMFQDITVVAGVEARGFIFGPPIALAIGAKFVPLRKPKKLPGEVISEEYSLEYGTDKIEMHVGAVQANDRALVVDDLIATGGTLCAAVKLIERVGAKVGECACVIELPEL

SEQ ID NO: 6549 - protein, 477 aa, Ceramium tenerrimum
KNERYESGVIPYAKMGYWDPEYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLESYLKVDLPKGIFFEQDWASLRKVTPVASGGIHCGQMHQLLDYLGNDVVLQFGGGTIGHPDGIQAGATANRVALEAMVIARNEGRDYVTEGPQILRDAAKTCGPLQTALDLWKDITFNYTSTDTADFVETPTANV

SEQ ID NO: 6550 - protein, 492 aa, Helianthus annuus
MDPYKYRPSSAYNAPFWTTNYGAPVYNNDSSLTVGTRGPILLEDYHFVEKLANFDRERIPERVVHARGASAKGFFEVTHDISALTCADFLRAPGVQTPVIVRFSTVIHERGSPETLRDPRGFAVKFYTREGNFDLVGNNFPVFFVRDGMKFPDMVHSLKPNPKSHIQEDWRILDFFSHHPESLHMFTFLQDDVGVPQDYRHMDGSGVNTYTLINKTGKTHYVKFHWRPTCGVKCLLEDEAIKVGGMNHSHATKDLYDSIADGNYPEWKLFIQTMDPDHEDRFDFDPLDVTKTWPEDILPLQPVGRMVLNKNIDNFFAENEQLAFCPAIIVPGIYYSDDKLLQTRIFSYADTQRHRLGPNYLQLPANAPKCAHHNNHHDGFMNFMHRDEEVIYFPSRYDPVRHAEQSPIPPVMLSGKRNKCVIEKENNFKQPGERFRSWDPDRQERFIRRIVGALSDPRVTHEVCTIWVSYWSQADKSLGQKIASRLNVKPSY

SEQ ID NO: 6551 - protein, 358 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTANTQQVTDAVCEAIAGSNIL

SEQ ID NO: 6552 - protein, 201 aa, Raphanus sativus
LEEVKDSNGNPVRVGAQYFIQPVKTESNNGGGLVPAATNILPFCPLGITQTLLPYQPGLPVSFGYHPNILGRDTIDTSANINIEFRSPIWPVCNEFSKLWAVDSSSASNEPAVIIGGEPKSPNSAFKIEKAAGAHTYKLTTSSGTVGTTPGAWLSAPQLLVTNDVAKTLFVKFVKVDNDATTATTSTSRVEKLGLKMFPFY

SEQ ID NO: 6553 - protein, 330 aa, Escherichia coli
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLPDAFGPKDLEIKTLLMDEQDHGYALTGDALSQAAIAAANRSHMPYSKSPSGVALECKDGRIFSGSYAENAAFNPTLPPLQGALILLNLKGYDYRISAARGSGRKSRCAVDSVGCHLRNAESSRLSQYRPSASRLSLVPDARERLVRLPALSWCRNSRQTVCRFLRKTSG

SEQ ID NO: 6554 - protein, 519 aa, Ipomoea purpurea
MATLTLIFCTLVFAIFLYFLILRVKQRYPLPLPPGPKPWPVLGNLPHLGEKPHQSIAAMAERHGPLMHLRMGFVDVVVAASAAVAAQFLKVHDANFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPILGWFDLQGIVGKMKKLHARFDAFLNSILEEHKFVNNQHTTLSKDVDFLTTLIRLKDNGADTDSEEGKLTDTEIKALLLNLFTAGTDTSSSTVEWAFAELLRNPKILNQAQQELDSVVGQNRLVTESDLTHLPFLQAIVKETFRLHPSTPLSLPRMGAQGCEINGYFIPKGATLLVNVWAIARDPNVWTNPLEFKPHRFLPGGEKPNVDIKGNDFEVIPFGAGRRICSGMSLGIRMVHLLVATLVHAFDWDLMNGQSVETLNMEEAYGLTLQRAVPLMLHPKPRLQPHLYTLN

SEQ ID NO: 6555 - protein, 760 aa, Arabidopsis thaliana
MWRLRIGAKAGNDTHLFTTNNYVGRQIWEFDANAGSPQELAEVEEARRNFSNNRSHYKASADLLWRMQFLREKGFEQKIPRVRVEDAAKIRYEDAKTALKRGLHYFTALQADDGHWPADNSGPNFFIAPLVICLYITGHLEKIFTVEHRIELIRYMYNHQNEDGGWGLHVESPSIMFCTVINYICLRIVGVEAGHDDDQGSTCTKARKWILDHGGATYTPLIGKACLSVLGVYDWSGCKPMPPEFWFLPSSFPINGGTLWIYLRDIFMGLSYLYGKKFVATPTPLILQLQEELYPEPYTKINWRLTRNRCAKASCKYKSHVIYIRKKIVLRFMYACLILLRTACVHIFSESILNRWPFNKLIRQAALRTTMKLLHYQDEANRYITGGSVPKAFHMLACWVEDPEGEYFKKHLARVSDFIWIGEDGLKIQSFGSQLWDTVMSLHFLLDGVEDDVDDEIRSTLVKGYDYLKKSQVTENPPSDHIKMFRHISKGGWTFSDKDQGWPVSDCTAESLKSKQMICSNSQCCLLFERMPSEFVGQKMDVEKLFDAVDFLLYLQSDNGGITAWEPADGKTWLEVSFYFVICHIPLRPGSAIVALTQFSKQFPEFRKKEVERFITNGVKYIEDLQMKDGSWCGNWGVCFIYGTLFAVRGLVAAGKTFHNCEPIRRAVRFLLDTQNQEGGWGESYLSCLRKKYTPLAGNKTNIVSTGQALMVLIMGGQMERDPLPVHRAAKVVINLQLDNGDFPQQVVIISCLFFIHSNI

SEQ ID NO: 6556 - protein, 451 aa, Zea mays
MRPPPPPLPSLRSSALVLVLLPLLAACSSPASGRAVPLASPPGTASVAPAPPPVVIIVERRNRFHRELVVACALASIAIAAIILSALYAWVLWRRSRRLPRGNKGARSADTASARGIMMAPILSKFNSLKTSRKGVVAMAMIEYPSLEAATGKFSASNVLGVGGFGCVYKAVFDGGVAAAVKRLEAGGPECEKEFENELDLLGRIRHPNIVTLLGFCVHEGNHYIVYELMHKGSLDTQLHGASRGSALSWHVRMKIALDMARGLEYLHEHCSPPVIHRDLKSSNILLDSDFNAKISDFGLAVTSGNIDKGSMKLSGTLGYVAPEYLLDGKLTEKSDVYAFGVVLLELLMGRKPVEKMSQTQCQSIVTWAMPQLTDRTKLPNIVDPVIRDTMDPKHLYQVAAVAVLCVQPEPSYRPLITDVLHSLVPLVPVELGGTLRVAEPPSPNLKHSAC

SEQ ID NO: 6557 - protein, 497 aa, Oryza sativa
MSSSLASRRSSSSSAAKRPAAGEGGGKAAAGAAAAKKRVALGNITNVAAAANNAVREGSLKFNSATWAAPVKKGSLASGRNVGTNRVSAVKSASTKPASAISRHESAPQKESVLPPKVLRIVPTAAPAPVTVPCSSFVSPMHSGDSVSVDETMSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 6558 - protein, 235 aa, Medicago sativa subsp. X varia
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 6559 - protein, 263 aa, Triticum aestivum
MDAGTGAGAGAPYASRTAEEVFRDFRGRRAGMIKALTQEVDKFYQLCDPEKENLCLYGYPNETWEVTLPAEEVPPEIPEPALGINFARDGMNEKDWLALVAVHSDSWLLAVSFYFAARFGFDKEARRRLFNMINNLPTIFEVVTGAAKKQIKEKAPNSTHKSNNKPSMKTYSKPESQSKAPKIAAPPKDEDESGEDYGEEEEEERDNTLCGTCGTNDGKDEFWICCDNCERWYHGKCVKITPARAEHIKHYKCPDCSNKRARA

SEQ ID NO: 6560 - protein, 108 aa, Zea mays
VDYACTPEEVQQHFNSCGTVNRVTILTDKFGQPKGFAYVEFVEVEAVQEAIKLNESELHGRQLKVAPKRTNVPGMKQPRGRGFNPYHGHPYMTPYGYSPYGYGQVVTG

SEQ ID NO: 6561 - protein, 359 aa, Catharanthus roseus
MDLQTAEFREAQAKIWSQAFSFANCAALKCAVKLGIADAIDNHDKKALTLSELTEELSIKPSKSPFLQRLMRQLVNAGFFTEAKQLRDDNKDGRTTTAYALTPVSRLLLKNEQWNLRGIVLTMLDPAELKAWSVLNDWFKNDDPTAFQTAHEKNYWDYTAENTQHCQIFEDAMANDSVLVSKLLVTEYKFLFEGLTSLIDLGGSTGTIAKALAKSFPNLKCTVFDLPHVVANLESTKNLEFVGGDMFEKLPPSNAILLKWILHDWNDEDCVKILKNCKKAIQEKGNGGKVIIIDTVVYSQKNEKELVDLQISMDMAMVINFAAKERTEEEWEHLIREAGFSGHKIFPMYDFRSIIEVYP

SEQ ID NO: 6562 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 6563 - protein, 295 aa, Listeria monocytogenes EGD-e
MEKKVGTDRVKRGMAQMQKGGVIMDVVNAEQAKIAEEAGAVAVMALERVPSDIRAAGGVARMADPRIVEEVMKAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIAGMTDDELMVAAKNFGAPYELIKEIKTLGKLPVVNFAAGGVATPADAALMMELGADGVFVGSGIFKSDNPAKFASAIVQATTYYTDYELIGKLSKELGSPMKGIEMSRLNPEDRMQDRSF

SEQ ID NO: 6564 - protein, 392 aa, Shewanella oneidensis MR-1
MSKATLNTDTVHRVGFLDKASLHIPILRILQADGTTYETAVLPVIDEALAIKIYDTCVFTRVLDERMLGAQRQGRISFYMTCTGEEAAIVGSVAALDPEDVILAQYREHAALRYRGFTTEQFMNQMFSNEKDLGKGRQMPIHYGCAALNYQTISSPLATQIPQATGVGYSLKMQGKRNVAVCYFGEGAASEGDFHAGLNMAAVLKCPVIFFCRNNGYAISTPTEEQFAGNGIASRGVGYGMHTIRVDGNDMLAVLAATQQARAYAIEHNAPVLIEAMTYRLGAHSSSDDPSGYRSKEEEAKWQQHDPVKRFKLWLINKGWLAEADDAQRYEKYREEVLAAVKVAEKLPIPMLDEIIEDVYDKPTPALKKQLSELKEHIKKYPQSYPKSAGRL

SEQ ID NO: 6565 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 6566 - protein, 526 aa, Oryza sativa
MAGDQMHVLSVLDSAKTQWYHFTVIDIAGMGFFTDAYDLFCISLVSKLLGRIYYTDIASDTPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLDTEIQEDADRAEAVAAGGAGNEWGLFSRHFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTNFLGMLMTLLVPESKGMSLEEVSKENVADDEEATA

SEQ ID NO: 6567 - protein, 539 aa, Neurospora crassa
MEHDHSASDIEKEAVTVARPQGDVTRVEAPVTLKAYMMCVFAAFGGIFFGYDSGYISGVMGMKYFIETINGPGATFLPSKEKSLITSILSAGTFFGALMGGDLADWVGRRPTIIFGCLVFIVGVVLQTASQSLGLIVAGRLVAGFGVGFVSAIIILYMSEIAPRKVRGAMVSGYQFCICLGLLLASCVDYGTQNRTDSGSYRIPIGLQMAWALILATGIFFLPESPRFFVKKGKLDKAAGVLSRLRDQPLDSDYVRDELAEIVANHEFEMTVVPYGNYFQQWANCFRGSIWQGGSYLRRTILGTSMQMMQQWTGINFIFYFGTTFFQQLGTIDNPFLMSLVTTLVNVCSTPISFYTMEKLGRRTLLIWGALGMLICEFIVAIVGTCRPDDTMAIKAMLAFICIYIFFFATTWGPASWVVIGEVFPLPIRAKGVALSTASNWLWNCIIAVITPYMVDEDKGNLGPKVFYIWGGLCTCCFIYAYLLVPETKGLTLEQVDQMLSESTPRTSTKWKPHTTYAAEMGMTEKTVAGHAENRSDSE

SEQ ID NO: 6568 - protein, 379 aa, Zea mays
MGRGSEAVPDARRAALLLIVCLAARAASAIQDGLLPNGNFEEAPPKSQLNGTRVMGRNAIPHWEISGYVEYIGSGQKQGDMLLPVPEGAYAVRLGNEASIQQRLAVTPGARYSITFSAARTCAQAEQLNVTVAPESDVLPIQTVYTSSGWDSYSWAFQAAGSVVTLIVHNPGVAEDAACGPLIDLFAIKTMPTPRSSKNNMLKNGDFEDGPYIFPNTQWGVLVPPMDEDDYSPLAPWMVLSSTKSVKYVDAPHHAVPHGARAVELVSGMETALVQNVTTVPGQLYRLQFSAGDAGNGCVGSMTVQAYAARGSVKVPYQSQGKGGHTRGVLDFAAVADQTRVVFVSMGYIMKPDGTLCGPVVDDVSLVSTRNHPARRLLL

SEQ ID NO: 6569 - protein, 620 aa, Burkholderia fungorum
MSVVIPDLRKRDMKVKGERQFPCRTPPTPCAPEPYRHTSSHCSFDEQHRTHCSETGRCLLTGWNSAARHAVRERLSRVHESPARCIGTLLAVACRGQAKYRAEYSPFKHVRSTQMNHAEMQFLTTEFPYKKQYANFIGGEWVKPVGGEYFDNVSPITGEAFTSIPRSREADVELALDAAHRAKTAWGKTSAADRANILNRIADRMEANLQRLAVAETIDNGKPLRETTAADIPLAIDHFRYFAGAVRAQEGSLSEIDHDTVAYHFHEPLGVVGQIIPWNFPILMAVWKLAPALAAGNCVVLKPAEQTPASILVLVELIQDLLPPGVLNVVNGFGLEAGKPLASSKRIAKIAFTGETTTGRLIMQYASQNIIPVTLELGGKSPNIFFADVMNEDDSFFDKALEGFAMFALNQGEVCTCPSRVLIDEKIYDRFMERALKRVAAITQGHPLDTKTMIGAQASQEQLEKILSYVDLGKQEGAECLIGGERNALGGELSKGYYVKPTVFRGNNKMRIFQEEIFGPVVSVTTFRNEEEALEIANDTLYGLGAGVWTRDGTRAYRFGRQIQAGRVWTNCYHAYPAHAAFGGYKQSGIGRENHKMMLDHYQQTKNLLVSYSDKPLGFF

SEQ ID NO: 6570 - protein, 154 aa, Nostoc punctiforme
MEIRSPAFFIGNTIPFKYTCDGDNISPPIYWEAAPQETKSFALIVDDIDAPNETFIHWVIYNIPADIRELPEGVAKQPKLPEGALQGKNNFGELGYGGPCPPKNGAHRYFFTIYALDQMLDLAAGANKQQLLAAIKNHILDKAELMGRYAREIE

SEQ ID NO: 6571 - protein, 494 aa, Geobacillus stearothermophilus
SSIAAPKLKEKVEKFLSGKKKMYINGSFVESASGKTFDTPNPATGERLATVYEGDAEDIDRAVKAAREAFDRGPWSRMSAAERSRLMYKLADLMEENKEELAQLETLDNGKPIRETINADVPLAIEHMRYYAGWSTKIVGQTIPVNGPYFNYTRHEPVGVVGQIIPWNFPLLMAMWKLGAALATGCTVVLKPAEQTPLSALYLAELIEEAGFPAGVVNIVPGFGETAGDALVKHPQVDKIAFTGSTEVGKLIMANASKSLKRVTLELGGKSPNIILPDADFSKAIPGALNGVMFNQGQVCCAGSRVFIQKKQYDNVVADMVSHAKSIKQGFGLKADTEMGPLVSSEQQNRVLGYIEKGLEEGAELLTGGQKPSEQGYFVEPTIFANVEDSMTISKEEIFGPVIAALPYEDIDELIERANDTNYGLAAGVWTRDVTKAHYIANKLRAGTVWVNCYNVFDAASPFGGYKESGIGREMGSYALDNYTEVKSVWIAQN

SEQ ID NO: 6572 - protein, 822 aa, Oryza sativa (japonica cultivar-group)
MAAAAGEEVEAARWAEAEDERKEGLRRRRRYGLVEYRALPGYMRDNEYILRHYRCEWPLPQVLLSAFSIHNETLNVWTHLIGFFIFLVLTIYTATQVPNVVDLQSLQHLPDVLRNADLHKIQTELVACLPSLPHLSDLQKLKDELKSSWNSIEVLPSLSRWHLLELLSSCLPHRFTHSNETSLSVLQSMKEDIANMIAPQLIRPIPRWPFYAFLGGAMFCLLASSTCHLLSCHSRRLAYIMLRLDYAGIAALIATSFYPPVYYSFMCYPFFCNLYLSCITILGVATIAFSLLPVFQNPEFRTIRACLFFGMGASGVIPVIHKLILFWHQPEALHTTAYEVLMGLFYGIGALVLLKFNAYINCVYNRSLGSEMNVQVARILASQQTHPHMDLLRRVAVVAVLLSLPSRGRSGGGGSDLHPVVLVPGYGSNRLYARLTAAYEPAAPRCGAREGKDEWFQLWPIDAAASEPAQAPCLAEKMSLVYDPVADDYRNVAGVVTRVPSFASTRALVGWDPLVRQLEAMGHRDGGSLFAAPYDFRYAVAPRGHPSAVGERYFARLTRLIERASRLNGGRPAVVVAHSFGCALTYQFLRARPLAWRQRFVKHAVLLAAALGGFAEGMDGLASGAGSGLPNLAPPARARLARSQQSALWRLPTPMVFGDRPVVVTKNSTYSANNITEFLDAIGFTEGVQPYVTRVLPMWRALPAPMVPVTSMYGVGVRTPETFVYGEAGFEGTPEVVYGDGDGNMNIVSLMAAEEWSGVEGQILKVVRLPGVSHVGFFSDLALKKVVAEIQKAVSSIEVHRKEKIFSFLNNFEFTIPVPLGW

SEQ ID NO: 6573 - protein, 321 aa, Agrobacterium tumefaciens str. C58 (Cereon)
MPLAGRGRFRRETPVDRLKFGHNKMALPHIFLALITVFLWGFNFVAIKVGVADMPPLFLTGVRYLFAAVPLVFFLPKPNVPWRHMIVYGMAMGFFQFGLLYPAIKLGLPAGLASLVMQSQAFFTLALAVVFLGERPLPSQIAGAIVAFGGLAVIGMERMTAAALIPLLMGVGSAIAWACGNIVNRRIGQVNVVSFIAWTSLVPVLPLVLLSLVVEGPDAIVEGLQNATPTMALVVIYMAYGATIVGAGIWSYLLLRYPAGTVAPFSLLVPIVGFISAYLAFAEHITIFEIIGAALVILGLALNVFGRRIGVSRFWVRSPQG

SEQ ID NO: 6574 - protein, 874 aa, Hypocrea jecorina
MKTLSVFAAALLAAVAEANPYPPPHSNQAYSPPFYPSPWMDPSAPGWEQAYAQAKEFVSGLTLLEKVNLTTGVGWMGEKCVGNVGTVPRLGMRSLCMQDGPLGLRFNTYNSAFSVGLTAAASWSRHLWVDRGTALGSEAKGKGVDVLLGPVAGPLGRNPNGGRNVEGFGSDPYLAGLALADTVTGIQNAGTIACAKHFLLNEQEHFRQVGEANGYGYPITEALSSNVDDKTIHEVYGWPFQDAVKAGVGSFMCSYNQVNNSYACQNSKLINGLLKEEYGFQGFVMSDWQAQHTGVASAVAGLDMTMPGDTAFNTGASYFGSNLTLAVLNGTVPEWRIDDMVMRIMAPFFKVGKTVDSLIDTNFDSWTNGEYGYVQAAVNENWEKVNYGVDVRANHANHIREVGAKGTVIFKNNGILPLKKPKFLTVIGEDAGGNPAGPNGCGDRGCDDGTLAMEWGSGTTNFPYLVTPDAALQSQALQDGTRYESILSNYAISQTQALVSQPDAIAIVFANSDSGEGYINVDGNEGDRKNLTLWKNGDDLIKTVAAVNPKTIVVIHSTGPVILKDYANHPNISAILWAGAPGQESGNSLVDILYGKQSPGRTPFTWGPSLESYGVSVMTTPNNGNGAPQDNFNEGAFIDYRYFDKVAPGKPRSSDKAPTYEFGFGLSWSTFKFSNLHIQKNNVGPMSPPNGKTIAAPSLGSFSKNLKDYGFPKNVRRIKEFIYPYLSTTTSGKEASGDAHYGQTAKEFLPAGALDGSPQPRSAASGEPGGNRQLYDILYTVTATITNTGSVMDDAVPQLYLSHGGPNEPPKVLRGFDRIERIAPGQSVTFKADLTRRDLSNWDTKKQQWVITDYPKTVYVGSSSRDLPLSARLP

SEQ ID NO: 6575 - protein, 371 aa, Bacillus subtilis subsp. subtilis str. 168
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 6576 - protein, 290 aa, Coxiella burnetii RSA 493
MDASHLSLSFELFPPKTLTGFENLKSVWRTLQDKTPDYFSVTFGAGGGNQDKTMRVVRALRQDFIEVAPHLTCIGLSKTAIFDLLNNYRLLGIKRIVALRGDLPLEEDIAGGDFNHANELVAYIRKLTGDYFHIEVAAYPEFHPETRTVQEALKNFQQKIAAGANGAITQYFYNRDAYFNFVDACRNVGIEAPIVPGIMPISDFDKLVRFSKTCATEIPRWLYKRLESYKNDKASLKAYGVEVVTKLCEDLIAYGVPGLHFYTLNQCEPTQTIIENLQSITSFREQAVVA

SEQ ID NO: 6577 - protein, 351 aa, Medicago sativa
  unsure (1)..(351): unsure at all Xaa locations
ASSINGRKPSEIFKAQALLYKHIYAFIDSXSLKWAVEXNIPNIIQNHGKPISLSNLVSILQVPSSKIGNVRRLXRYLAHNGFFEIITKEEESYALTVASELLVRGSDLCLAPXVECVLDPTLSGSYHELKKWIYEEDLTLFGVTLGSGFWDFLDKNPEYNTSFNDAXASDSKLINLALRDCDFVFDGLESIVDVGGGTGTTAKIICETFPKLKCIVFDRPQVVENLSGSNNLTYVGGDXFTSIPNADAVLLKYILHNWTDKDCLRILKKCKEAVTNDGKRGKVTIIDXVIDKKKDENQVTQIKLLXDVNXACLNGKERNEEEWKKLFIEAGFQHYKISPLTGFLSLIEIYP

SEQ ID NO: 6578 - protein, 215 aa, Streptococcus agalactiae 2603V/R
MKYFLDTADVSEIRRLNRLGIVDGVTTNPTIISREGRDFKEVINEICQIVDGPVSAEVTGLTCDEMVTEAREIAKWSPNVVVKIPMTEEGLAAVSQLSKEGIKTNVTLIFTVAQGLSAMKAGATFISPFVGRLEDIGTDAYALIRDLRHIIDFYGFQSEIIAASIRGLAHVEGVAKCGAHIATIPDKTFASLFTHPLTDKGIETFLKDWDSFKKK

SEQ ID NO: 6579 - protein, 414 aa, Aglaothamnion sp. USA
  unsure (1)..(414): unsure at all Xaa locations
FSCXVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGIWARKNDMILHLHRAGNSTYSRQKVHGMNFRVICKWMRMAGVDHIHAGTVVGKLEGDPLMIRGFYNTLLEAHLDICLPQGIFFEQDWASLRKVTPVASGGIHCGQMHQLLDYLGNDVVLQFGGGTIGHPDGIQAGATANRVALESMVIARNEGRDYVAEGPQILRDAAQTCGPLQTALDLWKDITF

SEQ ID NO: 6580 - protein, 430 aa, Bacillus subtilis subsp. subtilis str. 168
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 6581 - protein, 655 aa, Oryza sativa
  unsure (1)..(655): unsure at all Xaa locations
MSMSPRPMGVPGSMPQSMPAPFANNMQGQGLPHGPLLLLPRQLPDHASLATDTDKPSTYVCTPPNLMEGHGVTKQFQGRLHVVPPHSASFSPGRLLGPDSRVGPQFVSGESPGIPPGVASPLRXYIIHNHLIVIHLCMLFHWWYGLVALTAELYDLRRTWXFLDTWGIINYLASGSVHRGLRMATSLLREEPTGELQLLTAPLKSIDGLILFDRPKCNLQAEDISSLASNSEVVDFDAGLAELDGKIRERLSESSCSYCLQPLTSLHYQSLKEADIALCSVCFLDARYITGHSSLDFQRIDGDNDRSENDGDSWTDQETLLLLEGIEKYNDNWNNIAEHVGTKSKAQCMYHFIRLPVEDGLLENIEVPDASVPFRAETNGYPHLDCNGXLQVGFLASAMGPRVAASCASAALSVLTVDDDSRVNSEGICSDSRGQGPHPNFRDHNGGVSSSISPEKVKHAAMCGLSAAATKAKLFADQEEREIQRLTATVINHQLKRLELKLKQFAEVETLLLKECEQVERIRQRIASDRVRIVSTRLASPGNSLPGGSTSTMSSNPMSMSPRPMGVPGSMPQSSMPAPFANNMQGHGHPQMAFLQQQQRQQMLSFGPRLPLSAIQTQPSPQTSNIMFNPGMPNSVTPNHHQLLRSSSGNNSSVG

SEQ ID NO: 6582 - protein, 539 aa, Glycine max
MAREQIQVLNALDVAKTQWYHFTAIIIAGMGFFTDAYDLFCISLVTKLLGRIYYHVDGAAKPGTLPPNVSAAVNGVAFCGTLSGQLFFGWLGDKMGRKKVYGMTLMLMVICSIGSGLSFGHSAKSVIATLCFFRFWLGFGIGGDYPLSATIMSEYSNKKTRGAFIAAVFAMQGFGILAGGFFAIIISVAFKERVDAPPYELDPAGSTVPQADYIWRIIVMVGALPAALTYYWRMKMPETARYTALVAKNTKQAAADMSKVLQVEIQAEPQKEEQKANSYGLFSKEFLRRHGLHLLGTASTWFLLDIAFYSQNLFQKDIFSAIGWIPPAKTMNAIEEVYRIARAQTLIALCSTVPGYWFTVALIDKIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKADAGYPAGIGVKNALIVLGVVNILGFFFTFLVPEANGKSLEEMSGENDEDVGTQEESEQSHSQNNNRTVPYV

SEQ ID NO: 6583 - protein, 288 aa, Arabidopsis thaliana
MESYKCRVCFKSFVNGKALGGHMRSHMSNSHEEEQRPSQLSYETESDVSSSDPKFAFTSSVLLEDGESESESSRNVINLTRKRSKRTRKLDSFVTKKVKTSQLGYKPESDQEPPHSSASDTTTEEDLAFCLMMLSRDKWKKNKSNKEVVEEIETEEESEGYNKINRATTKGRYKCETCGKVFKSYQALGGHRASHKKNRVSNNKTEQRSETEYDNVVVVAKRIHECPICLRVFASGQALGGHKRSHGVGNLSVNQQRRVHRNESVKQRMIDLNLPAPTEEDEVSVVFQ

SEQ ID NO: 6584 - protein, 521 aa, Zea mays
  unsure (1)..(521): unsure at all Xaa locations
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMNCQGWKERLHNKQRGRSKSPDRPGRRILXIRSGIVVVLKNATIKDGTVI

SEQ ID NO: 6585 - protein, 155 aa, Glycine max
MSSLDLFAPSAETRRLSVKLTNDQLEKIGMTKQEAADFQRLRNRFLDKPLMEWERVKPLPDDFCKSAEDLPEPSPEKAKELLNKLVFVQLNGGLGTAMGLKSTKSGLQILKQGGSAYTILDCKILQLEALNNQYGVDIPLVLMNSPKTNEETLKL

SEQ ID NO: 6586 - protein, 861 aa, Ralstonia metallidurans
MTGRGTWEETCRGNSAGDSAGKAHRHGAYCTETQRCPKQKAYCEILFHNIKCTLPKAPTAETAGSWSRPALNRQRYSVRLHRSEDAQMTSPQQSPSQDDLKQQQREALRKAALEYHEFPTPGKISVTPTKPLSNQRDLALAYSPGVAAACEEIVANQANSFRYTARGNLVAVITNGTAVLGLGDIGAAASKPVMEGKAGLFKKFAGIDVFDIEVDEKDPEKLVDIIASLEPTFGGINLEDIKAPECFYVERKLRERMKIPVFHDDQHGTAIVVGAAVINGMQVVGKDISKVKLVASGAGAAALACLDLLVDLGLPIENIWVTDLAGVVYEGRTELMDPEKARFSQKTDKRKLAEVIEGADIFLGLSAAGVLKPEMVQKMADKPLVMALANPNPEIMPELVKEVRPDAVIATGRTDYPNQVNNVLCFPFIFRGALDCGATTITREMEIAAANAVAELARQEQSDIVASAYGIQDLSFGPEYLIPKPFDPRLIVKIAPAVAEAAAKSGVASRPIEDMDAYRLQLQQFVYHSGTLMKPIYAAARKVQKEKKRIVFAEGEEERVLRAVQVIVDEKLANPILIGRPAVLAHRIERFGLRLRMGEDFTVVNPEHDERFREYSDAYYRMMAREGITPQYAKLEMRRRTTLIGAMLVEKGEADGMICGTVSTTAAHLRYIDQVIGGTNCVYAAMNGLVLPGRQIFLVDTHVNVDPTAEQLAEITIMAAEELKRFGIEPKVGLLSHSNFGTSEAPSARKMRDTLKILRDRAPDLEVDGEMHGDSALDEKLRDSLVPDSALKGEANLLVCPNIDAANISYNLLKVAAGNNVAIGPILLGVKAPVHILTPSATVRRIVNMTALVVVDAAAKV

SEQ ID NO: 6587 - protein, 480 aa, Ptilophora diversifolia
SRIKSKRYESGVIPYAKMGYWDPDYVIKETDVLALFRITPQPGVDAVEASAAVAGESSTATWTVVWTDLLTACDLYRAKAYRVDPVPNTTDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDEKINSQPFMRWKERFLYSMEGVNRSIAGTGEVKGHYMNVTAATMENMYERAEFAKQLGTVIVMIDLVVGYTAIQTMAVWARKNDMILHLHRAGNSTYSRQKSHGMNFRVICKWMRMAGVDHIHAGTVVGKLEGDPLMIKGFYNTLLLSHLDMNLPQGIFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 6588 - protein, 663 aa, Oryza sativa
  unsure (1)..(663): unsure at all Xaa locations
MWRLKVAEGGGALLRSTNGFLGRAVWELDPDHGTPEDRADVERVRREFTDDRLRRRESADLLMRMQFAKQKKLQRRRDSIPPAVKLGEKEQVTEEIAMASLRRALDEFSSLQADDGHWPGDFSGVMFIMPGLMLGVYEWAGNNPIFPELWLAPQFLPFHPGKFWCLTRMVYLPMAYLYGKKFVGPTTPTILALREEIYPVHYLTIDWAQARSACAKEDLVCPRTRLQNAVWSWLYKWVEPVMSSWAMNKLRGRALDALMEHIHYEDENTQYLCICSVNKALNMVCCWAEDPNSDAFKRHLARVPDFLWLSEDGMKAQVYDGCQSWETALIIQAFCATDLVNEYASTVQRAHEFMKNSQVVRNHPGDQSYWHRHRSKGSWTLSSADNGWAVSDTTAEALKAVLLLTKISSSMVGDPIERERLYDAVDCLLSFVNKDGTISTYECKRTSTWIEILKPCESFPNMVVDYPYPECTSSVLQALVLFKELCPGYRTEEIEECVRNASMFIENTQRKDGSWLGTWGVCFTYGAFFSVQGLIAAGRTYENSSSIRKACDFILSKQLNTGGWGESHVSNETKVYVNIKGDRAHVVNTAWAMLXLIYAGQMERDPTPLHCAAKELINMQLETGEFPQQEHVGCFNCSLFFNYPNYRNIFPIWALGEYCWHLR

SEQ ID NO: 6589 - protein, 542 aa, Arabidopsis thaliana
MAKKGKEVLNALDAAKTQMYHFTAIVIAGMGFFTDAYDLFSISLVTKLLGRIYYHVDSSKKPGTLPPNVAAAVNGVAFCGTLAGQLFFGWLGDKLGRKKVYGITLMLMVLCSLGSGLSFGHSANGVMATLCFFRFWLGFGIGGDYPLSATIMSEYANKKTRGAFIAAVFAMQGFGILAGGIVSLIVSSTFDHAFKAPTYEVDPVGSTVPQADYVWRIVLMFGAIPALLTYYWRMKMPETARYTALVARNTKQAASDMSKVLQVDLIAEEEAQSNSNSSNPNFTFGLFTREFARRHGLHLLGTTTTWFLLDIAYYSSNLFQKDIYTAIGWIPAAETMNAIHEVFTVSKAQTLIALCGTVPGYWFTVAFIDILGRFFIQLMGFIFMTIFMFALAIPYDHWRHRENRIGFLIMYSLTMFFANFGPNATTFVVPAEIFPARLRSTCHGISAASGKAGAIVGAFGFLYAAQSSDSEKTDAGYPPGIGVRNSLLMLACVNFLGIVFTLLVPESKGKSLEEISREDEEQSGGDTVVEMTVANSGRKVPV

SEQ ID NO: 6590 - protein, 215 aa, Zea mays
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRKPRKLPGEVISEKYVLEYGTDCLEMRVGAIERSGERVLVIDDLVATGGTLCAAIRLLERAGADVVECACVIGLPKFKDLYKLNGKPVYVLVESRE

SEQ ID NO: 6591 - protein, 497 aa, Zea mays
  unsure (1)..(497): unsure at all Xaa locations
MATCATTLAPLLGPAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGKLLFGSGIIDFAGSSVVHMVGRHRGAAGRAHRGPPHXRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 6592 - protein, 349 aa, Azotobacter vinelandii
MVVKAYGAYAGDKPLEPLEITRRPPGPHDVQIDITYCGICHSDLHQVRAEWAGTRFPCVPGHEIVGRVSAVGAHVSDFRAGDLVGIGCIVDSCRHCEECDAGLENYCDGMVGTYNFPTPDEPGWTLGGYSQRIVVHEGYVLRIRHPEDQLAAVAPLLCAGITTYSPLRHWQAGPGKKVGIVGIGGLGHMGIKLAHAMGAHVVAFTTSASKREDAKALGADEVVVSRNPGEMAAHAKSFDLILNTVAAPHDLDAFLSLLKRDGTLTLVGAPASPHPSPDVFNLIFKRRSIAGSMIGGIPETQEMLDFCAEHGIVADIELIRAEQINEAYERMLRGDIKYRFVIDSATLAG

SEQ ID NO: 6593 - protein, 402 aa, Oryza sativa; identical to SEQ ID NO: 1286

SEQ ID NO: 6594 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSA

SEQ ID NO: 6595 - protein, 479 aa, Desulfovibrio vulgaris (strain Miyazaki)
MTKHKLTTNAGAPVPDNQNAMTAGPRGPMLLQDVWFLEKLAHFDREVIPERRMHAKGSGAYGTFTVTHDITSYTKAALFSKIGKKTDLFVRFSTVAGERGAATAERDIRGFAIKFYTEQGNWDLVGNNTPVFFLRDPLKFPDLNHAVKRDPRTNMRSAKNNWDFWTSLPEALHQVTVVMSDRGIPASYRHMHGFGSHTFSFISPDNQRYWVKFHLRTQQGIKNLTDAEAEAIVARDRESHQRDLYDSIERGDFPRWTMYVQVMPEKDAEKLPYHPFDLTKVWFHKDCPLIEVGVLELNRNPENYFAEVEQAAFNPANVVPGISFSPDKMLQGRLFSYGDAHRYRLGVNHHLIPVNAARCPVHSYHRDGAMRVDGNHGSTLAYEPNSYGEWQEQPDFAEPPLAIRGDAAHWNFREDADYYDQPGRLFRLMTPQQQDELFQNTARAMGDAPEEIKRRHVGNCAKADPAYGAGVARALGLKM

SEQ ID NO: 6596 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 6597 - protein, 314 aa, Nostoc sp. PCC 7120
NGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVENRTITEEVNQALKDASEGPLKGILDYSELQLVSSDYQGTDASSIVDANLTLVMGNDLVKVMAWYDNECG

SEQ ID NO: 6598 - protein, 265 aa, Zea mays
  unsure (1)..(265): unsure at all Xaa locations
MAPLGDGGAAAAAASNNLVVSFGEMLIDFVPDVAGLSLAESGGFVKAPGGAPANVACAIAKLGGAXLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRXFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 6599 - protein, 578 aa, Bradyrhizobium japonicum USDA 110
MAINNVADLFVATLEQAGVKRIYGIVGDSLNAFTEALRRRGTIEWIHVRHEEVAAFAAAGEAEMTGSLAVCAGSCGPGNLHLINGLFDAHRSRVPVLAIAAQIPSAEIGGGYFQETHPQNLFRECSHYCELVSDASQLPFVIENAIRAAVGLRGVAVIAMPGDVAFRDPPRRALSTARGLALSAPKVVPEANELKALADLLNGAERITLFCGRGCAGAHAPLMQLAEALKSPIVHALGGKEHVEYENPYDVGMTGFIGFSSGYAAMHACDALVMLGTDFPYKQFFPTGCQIAQIDIRPENLGRRCKIDLGLIGDVKLTIEALLPLLKTKTQRKHLDDAVAHYKKAREGLDSLARGTPGSKPIHPQYLAKVVSDHASEDAVFTADVGTPTVWAARYLEMNGRRRLIGSFVHGSMANAMPQAIGAQASQPGRQVISLSGDGGFTMLMGDLITLTQMKLPVKVVVFNNGVLGFVALEMKAAGFVDTNVDLQNPDFAAMARAMGIFAKRVEDPGELPGAVKEMLAHNGPALLDVVTAKQELSMPPTITTEQIKGFSLWVLRAVMNGRGDEVLDLAKTNLLPR

SEQ ID NO: 6600 - protein, 398 aa, Pseudomonas putida KT2440
MPHDGSLLQATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFAFVVFKLALEHQVLTQAVHDLLVLAITLSMAVVPLVMMALARQLHDDSPVQASPETGQ

SEQ ID NO: 6601 - protein, 495 aa, Bradyrhizobium japonicum USDA 110
MMSVAYDFAHSPASEFMARPQHLLIDGRRVPASSGRTFKSLNPATGQVIATVAEGNEADVDHAVAAARRAFEGPWRTMRASERGQILLRWAELLKANAEEIIELESIDAGKPISATLRQDFPAAVDTLIYYAGWADKISGDVVPVRDDALTYTVREPVGVVAAIVPWNFPLMIGMWKLAPALACGCTIVMKPAELTSLSALRIAELALQAGLPAGVFNVVTGPGRVVGDALVNHPDVDKVTFTGSPGVGRGIMKGAAGNFKRVSLELGGKSANVIFDDADLEAASKAAASGIFFNAGQVCSAGSRVLVQEKAYDEVVERLAARAKSLKIGDPLDRKTALGPVISEKQMKSILDYVDIGQKEGASLVTGGTRVGERGYFISPAVFANVEHEMRISQEEIFGPVVSIIKFRDEADALRIANGTAYSLAAGVWSRDIGKLQRFAKRARAGTVWMNTYGYTDVRLPWGGERDSGLGREHGTAALDNFTEPKAVWMNLAV

SEQ ID NO: 6602 - protein, 498 aa, Nostoc sp. PCC 7120
MAINTGKNKLMNRHIRPWQRLLVLAIGSMVFAVFAPTIVQAVDTPTLESLSETTIKLQISIDTTWVLLSGFLVFFMQTGFAMLEAGLVRQRSVVNTLLENFIDAAVTVLAWWAVGFGIAFGTSAGGLFGIDTFFLSQLPGADGSYPLGAPGSTAAINTYTLFFFQFAFAATASTITTGSMAGRTDFIGDLIYSAIMGAISYPIIVHWAWNSNGWLGKLSYHDFAGGSIVHTVGGWTALVGAYLLGPRPDRPPWGKLPPAHNLALATLGTMILWFGWYGFNPGSTLGTANPGLIGLVTINTTLAAGAGALAALIFLYVRTGKWDLVYCLNGSLAGLVAITAPCAYVAPWASVLIGLTGGIAVVLGVSLIESLHIDDPVGAFSVHGISGMMGTLSIGFLGQEELTLNQKAGLLLGGGFDLLGIQMLGIVAITVFTVAFAFLMYGGLKAMGHLRVNAEADRIGIDTYEHGASVWPDVYSVEELSKPQEHTKISENKTLEGE

SEQ ID NO: 6603 - protein, 340 aa, Oryza sativa (japonica cultivar-group)
MRPSLMRSASQVLRRRRGYSSASGQPERKVAILGAAGGIGQPLSLLMKLNPLVSSLSLYDIAGTPGVAADVSHINAPAQVKGFMGDDQLGEALEGSDIVIIPAGVPRKPGMTRDDLFNINAGIVKNLCTAIAKYCPNALVNMISNPVNSTVPIAAEVFKKAGTYDEKKLFGVTTLDVVRAKTFYAGKANVPVTDVNVPVVGGHAGITILPLFSQATPATNALSDEDIKALTKRTQDGGTEVVEAKAGKGSATLSMAYAGAVFANACLKGLNGVPDVVECSFVQSTVTELPFFASKVKLGKNGVEEVLGLGQLSDFEKEGLENLKGELKASIEKGIKFANA

SEQ ID NO: 6604 - protein, 768 aa, Aspergillus awamori
MADSGLVDHSPHHPTKAAQLNTASNVILIDNYDSFTWNVYLVLEGATVNVFRNDQITLEELIAKKPTQLVISPGPGHPETDAGISSAAIQYFSGKIPIFGVCMGQQCIITCFGGKVDVTGEILHGKTSALKHDGKGAYEGLPDSLALTRYHSLAGTHATIPDCLEVSSSVQLTDDSNKDVIMGVRHKKLAVEGVQFHPESILTEYGRTMFRNFLKLTAGTWEGNGKHFDEQSNTTKATVSSNTAPKTDKKLSILERIYDHRRAAVAVQKTIPSQRPADLQAAYDLNLAPPQVPFPARLRQSPYPLSLMAEIKRASPSKGMIAENACAPAQARQYAKAGASVISVLTEPEWFKGSIDDLRAVRQSLEGLTNRPAILRKEFVFDEYQILEARLAGADTVLLIVKMLSVELLTRLYHYSRSLGMEPLVEVNTPEEMKIAVDLGAEVIGVNNRDLTSFEVDLGTTSRLMDQVPSSTIVCALSGISGPKDVEAYKKEGVKAILVGEALMRAADTAAFIAELLGGSSQNVSKESRSSPLVKICGTRSEEAARAAIEAGADLIGIIMVQGRTRCVPDDVALRISQVVKSIPKPAGQTPPTSRGTPAAASVEYFDHSARILRHPSRALLVGVFQNQPLDYILSQQQKLGLDVVQLHGSEPLEWAKLIPVPVIRKFGLDEPAIARRAYHSLPLLDSGVGGTGELLDQSRVQNVLDKDSGLRVILAGGLDPTNVAGIVQKLGESGRKVVGVDVSSGVESDGAQDLGKIRAFVQAVRGL

SEQ ID NO: 6605 - protein, 215 aa, Glycine max
  unsure (1)..(215): unsure at all Xaa locations
MVSACVTLKANTHLVKSRKDNTFRQDSGFLGERIKGGLNYSPWIINQLASSLRTQERVKKAKPGVVSAVLTSSNTKESVAFQMPSFLRRKADPKNVVSIILGGGPGIQLFPLTKRAATPAVPVGGCYRLIDIPMSNCINSGLNKIFVLTQFNSASLNRHISRTYFGNGINFGDGCVEVLAATXTQGETGKNWFQGTADAVRQFTWVFEDAKHTNI

SEQ ID NO: 6606 - protein, 344 aa, Burkholderia fungorum
MIGAAVLALAGGFAYTAGWLTPSRLTAPRLINTFETVAGQPHPGYRRNHAKGLCIEGYFDSNGDGAVLSRAAVFAPGRTPVTGRFAVPGGNPSAPDTSSPVRSLALQFLLQNGEQWRTGMNSTPVFAVHTPEQFYQQLVAAKPDPATGKPDPARLKAFYAANPETQPFQAWVKAHPPSSSLANAAYYSINAFRFTDSAGNTRAVRWAMVPETPYAPITDAEKAEKNFLEADLDQRLENGPLRWHLILTVAKPGDPTDDATLQWPDDRQHIDAGTLVVDHTTSQENGACRDVNFDPTILPAGIEPSDDPLLAARSAAYALSFKRRTREEALHPAVHQAQTNGEHS

SEQ ID NO: 6607 - protein, 330 aa, Rhodobacter sphaeroides
MKQFQIVGIGNALVDVLSHCDDAFLAENGIAKGIMQLIDMGRAVDLYGRIGPAQEISGGSAANTIAGIAQLGGRTAYVGKVCDDQLGAIFAHDLRAQGAVYETPMAPKGGAQETGRCIILVSPDGERSMNTCLGWSEFLTPDDIDEAQMASTEWIYLEGYRFDGPESHAAFAKAIAACRGAGGRVSLTLSDPFCVERHRDAFRRMIREDVDLLFANRAEILSMYRTEDFGAALKAAAAEVAIVACTESEKGAHILADGQHWHVPALPTQIVDATGAGDLFAGAFLWGLTHGHGYETAGRMGCIAASEVISHLGARPEADLRALFRAQGVL

SEQ ID NO: 6608 - protein, 155 aa, Oryza sativa
  unsure (1)..(155): unsure at all Xaa locations
HGQASLVLKDDQECSASHVHGNGPVEESNGCMPNQRIDEHGQIDFGHSLQLVLFSRQWGLAESLVALADHQLMLDYGLSVALDAIWFLRTEQDLQGLNHLIGKIVESGAKDFARAILRTSLLASCVVACQSKALTXRLHDRLQDCPGGERLQIEA

SEQ ID NO: 6609 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLHGNRWSLIAGRLPGRTDNEIKNYWNSTLSRKIGTAATAAAGSRGGSTPDTARATDAASSSSVVPPGQQLQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 6610 - protein, 363 aa, Buchnera aphidicola
MKKKFRIAVLPGDGIGPEVMREAYKILNILERKFFLKLELREFDIGGIAIDREGIALPEKTLRGCENSDAILFGSVGGKKWDYLPIESRPERASLLPLRKHFNLFSNLRPAKLRVDLKNLSPLRSDIVRDGFDILCIRELTGGIYFGKPKGRFKNKNGEYAFDTEIYYDFEIERIANLAFELASSRRCKVCSIDKANVLESSVLWREIVKKVSKNYPDVHLSHLYIDNACMQIIKNPTQFDILLCSNIFGDIISDECAMITGSIGMLPSASLNNQKFGLYEPAGGSAPDIEGKNIANPIAQILSLSMLIRYSMNLNEIADKIDLSVHYALKEGYRTLDISDGKNYIKTNEMGDIIAEFLDNGK

SEQ ID NO: 6611 - protein, 322 aa, Zea mays
MGSSSHSLAVSRRGRSARQSPFFRDLATPIPSHRGVSRFASGASPSSTPPPPPPIFTLDDRYASADFSPDPTASDLLPVASSPSPRTAASRSPPWDLSRGKVALSAPGSPMAGVVEPTRKEMLALPAPASPGTPPPAATAEAQSPVSPAQAPRTEPVANAGEVEREEWVTVFGFSIGDTNLVLREFEKCGVILRHHSGPRDGNWIHILYQRSYDARKALQKNVMQLSNSLIVGVKPIDAVHRQQLDKGFAQSNPGGFMVSLPSKSLGLKSAGASNQLGALPRPYDPKANTNVSRDAGRRATGSVAAPAKSIVTNVMDLIFGI

SEQ ID NO: 6612 - protein, 463 aa, Yersinia pestis KIM
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 6613 - protein, 484 aa, Zea mays
  unsure (1)..(484): unsure at all Xaa locations
RWSPDGLRIVVSGDGKGKSFVRAFVWDSGSTVGEFDGHSKRVLSCDFKPTRPFRIVTCXDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSASNPDQEPVTFAGHLKTVSSLVFFPQSSPRTILSTSYDGVIMRWIQGVGFGGRLVRRNNTQIKCFAAVEEELVTSGYDNKVFRIPLNGNQCGDAESVDIGGQPNALNLAIQKPEFALITTDSGIVLLHNSKVISTTKVNYAITSSSVSPDGTEAVVGAQDGKLRIYSISGDTLTEEALLEKHRGAITSIHYSPDVSMFASADTNREAVVWDRASREVKLKNMLYHTARINSLAWSPDSRLVATGSLDTCAIVYEIDKPVASRVTIKGAHLGGVHGLTFLDNDILVTAGEDACIRVWKVVQQ

SEQ ID NO: 6614 - protein, 412 aa, Streptococcus pyogenes SSI-1
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 6615 - protein, 425 aa, Glycine max
MESGVVAVNNNINNYESKATSTITIKGILSLLMESIDDENCDGGGSKKRVISLGMGDPTLTTLFHTPKVVEEAVADALQSRKFHGYAPTAGLLQARIAIAEYLSRDLPYQLSRDDVFITCGCTQAIDVSVAMLARPGANILLPRPGFPIYELCAAFRGVEVRHYDLLPEKGWEVDLDAVEALADQNTVALAIINPGNPCGNVYSYHHLEKIAETAKRVGTIVISDEVYGHLAFGSKPFVPMGVFGSTVPVLTLGSLSKRWIVPGWRLGWFVTNDPSGTFREPKVVERIKKYFDLLGGPATFLQAAVPQIIANTEEIFFEKTIDNLRHTADICCKEIEDIPCIFCPYKPEGSMAMMVKLNLSLLEDISDDIDFCFKLAKEESVIILPGTAVGLKDWLRITFAADPSALGEGMRRIKSFYQRHARKL

SEQ ID NO: 6616 - protein, 418 aa, Oryza sativa
MDTASFVTSLLTSFVIFVVLVLVFRWLSSRPGNAPVYYPSVLLRGLDPWEGRGRGTRSPVGWLRQAISASEGDVVAAGGVDAAVYLVFLSSVLSILVFSGIVLLPVLLPVAATDDNLNLERAIGLKNGKTPQNFTELEKLALGNVQEHSRRLWAFLLSVYWVSFVTYFVLWKSYKHVSNMRAAARSTPDVKPEEFAVLVRDVPKPPPDQTIKDSVDSYFRALHPDTFYRSMVVTDHTKADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPK

SEQ ID NO: 6617 - protein, 379 aa, Streptococcus pneumoniae TIGR4
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEHGVVIRGTAEHPVVVKKGAKVTEDIHS

SEQ ID NO: 6618 - protein, 159 aa, Frankia sp. FE138
ITREEYSRDPRNTARKAEAYLRGTGFADTAYFGPEAEFYIFDDVRYDYNPYGSLHAVDSVEAAWNTARKEEGGNLGYKPRFKGGYFPVPPTDHFTDLRSEMTRTLIRAGVTVEMQHHEVGTAGQAEIDIRYDTLLRTADNLMLYKYIIRNVAVARGKTV

SEQ ID NO: 6619 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 6620 - protein, 231 aa, Schizosaccharomyces pombe
MQLYSSESESDDSQYWVDWFLGLKGNEFFCEVDEDFIQDRFNLTGLSHEVPHYSQSLDLILDVLDPDLPEEVQDEVEASARHLYGLIHARYILTAQGLYKMLEKYKKCDFGHCPRVLCNGQPMLPVGLSDIAHTKSVKLYCPRCEDVYTPKSQRHASIDGAYFGTSFPHMLFQVYPELAVPKSQERYIPRIFGFKVHSYSATFKKQDVYKEKQKKRLQGAEAESKNKLAIT

SEQ ID NO: 6621 - protein, 605 aa, Azotobacter vinelandii
MPDRPGGIACRGRERRGDRRRGRRRRGVHRPGRSFHRPRPSRRSGPSAGAGAYPSRHRGHPRRRQGLRHPRPARGGRPPLPGMGLPVHRRRHRHQPAAPGRAGRPGALPRHSGVRRALAHLLNPRRIRMSSSVPVHRNYIDGAFVESAAHLEVFNPANGALLSRVPAASAEEVERALAAARAAQKDWARKPAIERAGHLRRIAAKIRADAGRIARTITLEQGKIASLAEVEVNFTADYLDYMAEWARRLEGEIIASDRPGENIFLFRKPLGVVAGILPWNFPFFLIARKMAPALLTGNTIVVKPSEETPNNCFEFARLVAETDLPRGVFNVVCGAGQVGGALSSHPGVDLISFTGSVETGARIMAAAAPNLTKLNLELGGKAPAIVLADADLELAVKAIRDSRIINSGQVCNCAERVYVQRQVAEPFIERIAAAMAATRYGDPLAEPEVEMGPLINRLGLEKIDAKVRTALAQGATLVTGGAIAERPGHHYQPTVLTGCRADTRIMREEIFGPVLPIQIVDDLDEAIALANDCEYGLTSSVFTRDLNKAMHALRELDFGETYINREHFEAMQGFHAGVRKSGIGGADGKHGLYEYTHTHVVYLQS

SEQ ID NO: 6622 - protein, 452 aa, Polyneuropsis stolonifera
ETDILALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAASGEIKGHYMNVTASTMEDMYERAEFAKQLGSVIIMIDLVIGYTAIQSMAIWSRKNDMILHLHRAGNSTYSRQKIHGMNFRVICKWMRMAGVDHIHAGTVVGKLEGDPLMIKGFYDTLLKSYLDINLPQGIFFQQDWASLRKVTPVASGGIHCGQMHQLLDYLGNDVVLQFGGGTIGHPDGIQAGATANRVALESMVIARNEGINYVAEGPQILVDAAKTCGPLQTALDLWKDITFNYTSTDTADFVETPTANV

SEQ ID NO: 6623 - protein, 756 aa, Pisum sativum
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDYGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 6624 - protein, 494 aa, GIBBERELLA ZEAE PH-1
MAENYHKEVISGLKNKSLFIQDAFINGQWVAKENKFDVFEPSTATVLGQVANCALEDFQTAIKSADVAQTKYFDSTTGASRGAMLRKWYDLVLANQEDLAKILSLENGKTYSEALGEVIYSASFISWFAEEATRSYGVTIPSSAPHTTLMTIREPVGVCGIITPWNFPAAMITRKIAPALAAGCSVVIKPPSETPYSALAFTKLAIEAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGGGLDKTTTQGPLVNKSAIDKVKEHIADATSKGAKIATGGSTPDSPGFFHQPTVLTGVTQEMAVAKDETFGPLAPVFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 6625 - protein, 354 aa, Schizosaccharomyces pombe
MNHGTKIPVDPFRIIKETARDGSTGEVKQLSYTSSKVVGSGSFGVVMQVHLIESDSKAAIKRVLQDKRFKNRELQIMRIMNDPNIVDLIAYYYTTGDNSDEVYLNLVLEFMPETIYRASRLYTRQKLSMPMLEVKLYIYQLLRSLAYIHASGICHRDIKPQNLLLDPENGILKLCDFGSAKILVAGEPNVSYICSRYYRAPELIFGATDYTHAIDIWSTGCVMAELMLGHPLFPGESGIDQLVEIIKILGTPSREQIKTMNPNYMEHRFPQIRPQPLSRVFSRSVPLDALDLLSKMLQYTPTDRLTAAEAMCHPFFDELRDPNTKLHNSRNPDASPRHLPELFNFSPFGTIHSS

SEQ ID NO: 6626 - protein, 447 aa, Glycine max
RPTRSGHRAAAADPRVQYHRPRAWVTAWERQRIWLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNIISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQTILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 6627 - protein, 106 aa, Glycine max
QEERAFFGIEGTKLYLVFRIIKDLTAVNEATLVDNVVVLWTDISETCSNFVASLNDAMGNFLAAVDGIDGEIFACTLNAIACVMEHDPFIDGISHITLGPWLIDLS

SEQ ID NO: 6628 - protein, 348 aa, Mycobacterium smegmatis
MSTVSAYAATSATEPLTKTTITRRAVGPHDVAFDIHFAGICHSDIHTVKAEWGVPNYPVVPGHEIAGVVTEVGSEVTKYKVGDRVGVGCFVDSCRECDNCKAGLEQYCTGTGMVGTYNAIDRDGTPTHGGYSGAIVVDENYVRIPDSLSLDAAAPLLCAGITTYSPLRHWNAGPGKKVAVIGLGGLGHVAVKLAKAMGADVTVLSQSLKKMEDGLRLGRSAYYATSDPETFDKLAGSFDLILNTVSANLDLGAYLGLLKLDGALVELGLPEHPMEVPAFPLLAQRRNLTGSMIGGIPETQEMLDFCAEHDVRPEIEIITPDYINEAYERVLASDVRYRFVIDTASLRS

SEQ ID NO: 6629 - protein, 164 aa, Zea mays
  unsure (1)..(164): unsure at all Xaa locations
PAGSGTHTPETTESPPRTNHEHPPGTHHSYRAVVAGAVSGTSVLNEPHNALHAAASSMFSMRLSEAYHYSLCMHQLLDMLXRYLVNSLLDAQDYDKHHQMIQSEHXDCRLTIQVIVNFSFSQPTALEALLEMSRMLNRMSLLISIAPTGSIPVTTDYNTLYDKN

SEQ ID NO: 6630 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSSMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 6631 - protein, 318 aa, Spirogyra sp.
KVGINGFGRIGRNFIRCWHGRDDSPLEVIAINDTGGVKQAAHLLKYDSMLGIFNADVKIADDNSISVDGKIIKVVSDRNPLNLPWGEMGIDLVIEGTGVFIDGPGAGKHIEAGAKKVLITAPGKGPIPTYVVGVNADKYVHSEPIISNASCTTNCLAPFVKILEEKFGIIKGTMTTTHSYTGDQRLLDASHRDLRRARAAALNIVPTSTGAAKAVSLVLPSLKGKLNGIALRVPTPNVSVVDLVIQTEKKTFAEEVNAAFREAAAGPMKGVLAVCDEPLVSIDFRCSDVSCTIDSSLTMVMGDDMVKVVAWYDNELGY

SEQ ID NO: 6632 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 6633 - protein, 365 aa, Methanosarcina barkeri
MPLAENVNLMDFAQITYGFVGADIAALCREAAMSALRRVLPKINLNEPEIPAEILDSLQVIREDFENALKDVQPSAIREILIEVPTVGWDDVGGLEEVKRLLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGASISEPQVTARILNQLLSEMDGLEELRAVVVIGATNRPDVIDPALIRPGRFDELILVPIPDEGARREIFKVHTEKMELAEDIDIEKLVSITDQYTGADIAAVCKKAGRLALREDIHAKNVKQRHFLKAITETGPSVTPDTMKYYEAIKGELRTRKSKEIENPSYI

SEQ ID NO: 6634 - protein, 629 aa, Oryza sativa
MESEMADAAPAPAVAAAATAEPLAAVAEEGEEGGEAAVGSTLTMERVAAAKKFIENHYRSQMKNIQERKERFSVEKCAVNVVWMRRLCLSLSAVDNTLVAYHLFVLSGWRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEIHYIQIESLGVAEVRDAERSESTTMGGPGRAFVRQSRGGLGRAARLNAEGGLGWVARTRTTAGEMDNAPTRTGSGPSRKMMLNSKDLSFVGYTYKNFDAVKGLKHSGPADMDPSREPNGRDKHMHTVSSGDPMIQ

SEQ ID NO: 6635 - protein, 358 aa, Arabidopsis thaliana
MAGIRLLPEEPETTPQQQARAAAAVTTTTTDSLASDDDRSIAADSWSIKSEYGSTLDDDQRHADAAEALSSANFRVSSDYSSDKEEPDADGGGQSMLGLQSYWDAAYSDELTNFREHGHAGEVWFGDDVMEIVTSWTKDLCVEISQRNMSVSENDVTTEVNDQADKYLSSWNVLDLGTGNGLLLHQLAKEGFSDLTGTDYSDGAVELAQHLSQRDGFPNIRFMVDDILDTKLEQQFKLVMDKGTLDAIGLHPDGPVKRVMYWDSVSKLVAPGGILVITSCNHTKDELVEEVENFNIRKSNLCRGDGNDANNVLSSGSEAASRIDQPPFEYLSHVRTYPTFMFSGSVGSRVATVAFLRK

SEQ ID NO: 6636 - protein, 684 aa, Oryza sativa
  unsure (1)..(684): unsure at all Xaa locations
MAKKAETEMPSRRLLAAAASPPPAAEEKAVVDGLRGSHGARRHAAGSAVGAGVAAVVALVLVALGLGLFVWLRRGRKRGAVAGGGAAARMGVGVGVGARTQPAPALRRLSCQQLRRATGGFAAGSKLGQGGFGPVFRGALPRSGQAVAVKVMDAAGSLQGEREFHNELSLASHLLGCGHGHGSPSILLPFAYSLSAQPRRRRMMLVYELMPNGSLQDALLGKRCPELVSEWPRRLAVARDVAAALHYLHSVAQPPVIHGDVKPSNVLLDGELRARLSDFGLAQIKSEERDELESAAIEGNGNESSNPCGGCDDDMSVADENATAVAVNGEDNAAKSPEDDEGFTMASPAEAASTSGCDKTSVSSGLNGRSCNGGGAAASGAGNDWWWRQDNGGGSGGVKDYVMEWIRSEIKKERPKNDWIAGASATTPATSTERKKTKRRAREWWREEYADELTKKQKRRALAKSRSEIGPMASMQWWERDCDLEEKGRSRWXMMKAWSRRSSNGNGSIDWWIDGVRRSSRDWASGEFVPKSGGAVSSTPSMRGTVCYVAPEYGGGGPLSEKCDIYSFGVLLLVLISGRRPLQVTASPMSEFEKASLISWARHLARVGRLLDLVDPALRDVNRDQALRCITVALLCIQRSPSRRPSSEEVLEMLSGEGEPPNLPVEFSPSPPGGFRFRSRKKGR

SEQ ID NO: 6637 - protein, 1027 aa, Arabidopsis thaliana
MVWFRIGSSVAKLAIRRTLSQSRCGSYATRTRVLPCQTRCFHSTILKSKAESAAPVPRPVPLSKLTDSFLDGTSSVYLEELQRAWEADPNSVDESWDNFFRNFVGQASTSPGISGQTIQESMRLLLLVRAYQVNGHMKAKLDPLGLEKREIPEDLTPGLYGFTEADLDREFFLGVWRMSGFLSENRPVQTLRSILSRLEQAYCGTIGYEYMHIADRDKCNWLRDKIETPTPRQYNSERRMVIYDRLTWSTQFENFLATKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVIGKTRAKQYYTKDENRTKNMGILIHGDGSFAGQGVVYETLHLSALPNYCTGGTVHIVVNNQVAFTTDPREGRSSQYCTDVAKALSAPIFHVNADDIEAVVHACELAAEWRQTFHSDVVVDLVCYRRFGHNEIDEPSFTQPKMYKVIRSHPSSLQIYQEKLLQSGQVTQEDIDKIQKKVSSILNEEYEASKDYIPQKRDWLASHWTGFKSPEQISRIRNTGVKPEILKNVGKAISTFPENFKPHRGVKRVRVYEQRAQMIESGEGIDWGLGEALAFATLVVEGNHVRLSGQDVERGTFSHRHSVLHDQETGEEYCPLDHLIKNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKQCVSNLSEFDDVKGHPGFDKQGTRFKRLIKDQSGHSDLEEGIRRLVLCSGKVYYELDEERKKSETKDVAICRVEQLCPFPYDLIQRELKRYPNAEIVWCQEEPMNMGGYQYIALRLCTAMKALQRGNFNDIKYVGRLPSAATATGFYQLHVKEQTDLVKKALQPDPITPVIP

SEQ ID NO: 6638 - protein, 799 aa, ASPERGILLUS NIDULANS FGSC A4
MVNPYETDPARIPEDDPFYQRSPQYGRYLPRDDDFQPRYDDWCQFDPQATEYWESTVKALCTPENSLHLHGERQAYAAGRVIIRVDQEDAVGAAAERFLCLNANELSASRKADNAFKHLGVDVPKIYYCGIIDGKNVTVEARIPGVSLDVAWRYLNPEQVEVMKQQCRIVSQELSGADPGLDHPSYVCNKVHRQIRVPRLMAESESGPLQNVQTWANLYESLPGTVLAEPVYPIKIEPSSTSLDRVPLDAEEVKNGIDALEEHPTPKKVVSLKNRGNSRASSSDRSSPANSTKAPGRRAGPGTKKGIGRKTSTKKSKLDNQDNESVSSRRSQTPSSSRTSKVPVKKQSSASLANSPAPEPKKKGGRKAKVEVEDEEMEEGEEGDEDEEESDPDAVFCICRKPDNHTWMIACDGGCEDWFHGKCVNIDPRDVDLIEKYICPNCKENGKGCTLWKPMCRLRECRKPARVSGPTPSKYCSDEHGLEFMRQKTRHLNFIPPQGIQKPKTIFRAALSGTQTPRDDDSEYDSQMEDEQDNSMEDLGSRGGVLTLGDLTAVIMGVSSVEEFRKLGAHIVAPPAEPAPDQVPPSDTTDAGTPPSKKLGLDVGVDGLHYSPDEAEKLEKLRKQRAELFHRRDMLTARNTFLTLVRHRSKSILDILKKKDPKGGWKDICGFDTRLAWSDEEFDEWRLSEPGKKALEEGTPEALAASYPTSNVDTDGDTAMGVEDEDSSASLTRGVCLKKRCERHKQWVKVQQQDVAFEERTLESDLAECEKEAREVVERAVLRMWAEDGNAQSQLENGW

SEQ ID NO: 6639 - protein, 454 aa, Thermosynechococcus elongatus BP-1
MPENSWPENSFYNEADPLDELLSEWVDDPESPPLQPRSEGRRRKAFLALSLIWGTTIAIHLIVGGIWLIYVLTLLMSLQTLRYWRAQPQSLPGSETAESVPPMVSLVVAAKNEEAVIGRLVKNLCRLDYPHYEVWIIDDNSSDRTPDILRELQKQYPHLNVLRRLPGAGGGKSGALNQVLPLTRGEIIGVFDADATVPPDLLQAVVNRFQVASVGAVQVRKAISNADINWLTQGQAVEMILDAYYQQQRVAWGGMGELRGNGQFVRRQALERCGGWNEETITDDLDLSLKLHLHGWQIDVLMNPAVQEEGVTTLLALWHQRNRWSEGGYQSYLDYWQPLLRNRLGWQKSWDVFCWFLIKYAIPTATIPDLLMAVLRHRPPVLVPLTTLSLTISMVGMLRGIPQAQSVGVGQLFWQSLWGTLYMFHWLPVVSTTTLRMALRAKRLRWVKTVHHGT

SEQ ID NO: 6640 - protein, 197 aa, Aquifex aeolicus VF5
MKVLMIDNYDSFTYNLVQYLGSLGADVIVRRNDQIRLEEVREINPDAIVISPGPCTPKEAGISVPLIKTYYKEYPILGVCLGHQSIGYAFGAKIVRAKRLMHGKTSQIFHTGEGVFKNLPSPFTAVRYHSLVIDKNTLPEELKITAWSDDEEIMGIEHKEYPVYGVQFHPESVLSEHGMEILKNFLELAEERKLVKK

SEQ ID NO: 6641 - protein, 242 aa, Antirrhinum majus
MGRGRVELKRIENKINRQVTFAKRRNGLLKKAYELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 6642 - protein, 456 aa, Oceanobacillus iheyensis HTE831
MLKKSFLIFTALLLLATPVYAATPTPESLELSVNLIWVMLGAFLVFFMHAGFAMVESGFTRSKNTLNILMKNFLTISVASILFFLVGYGIMFGSSAGSIIGSDGFLLSEISEIDFFVFQAMFVATCATIISGAVAERIKLGSYILIVAAMTTIIYPVVGHWVWQGDGWLTSLGFSDFAGSTVVHLTGAVGAFVVVLILGPRIGKYKGKKVNVIQGHNLPLGALGVFILWLGWFGFNGGSTLAADPSLVPYVIGTTLLSTSAALVSSSLYTKLRFKKVDASLSMNGVLGGLVGITAGAAEISLGGSIIVGLISGVVLVEGIRFLDTKLRIDDPVGAIAVHGICGIWGTLAIGLFSVNTGLFYGNGISQLGIQAIGVLAVVAWVAITAGGFTYVINKISQIRVSEEEEISGLDFAEHGSSAYNFKESLLEGTDNNSSSGLAERLNNNIPIGKTSNQSS

SEQ ID NO: 6643 - protein, 131 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 6644 - protein, 524 aa, Emericella nidulans
MPPNFAGLSGRKLSLTVSTVATMGFLLFGYDQGVMSGIISDVAFNDVFTATKDDATMQALVTAVYELGCLAGAVYALMFGDRMGRRWMILSGAAVMILGVIIQVTSFPGHIPLLQFFIGRVITGIGNGMNTSTIPTYQAECSKTSNRGLLICIEGGIIAIGTAIAYWIDFGSHYGPPDLVWRFPIAFQIIFGIIIIVGMWFLPDSPRHLIAKGRIEEGEYVLAALNGCEVHDHETQIQKQLTLDSLRASGALGKKTSFRDLLTGGPSQHLRRMLVGSSSQVFQQLGGCNAVIYYLPVLLKSNLHQDNDQALLIGGINMIVYAVFATFSWFFIERIGRRKLFLGGSMVQTTAMIITFACLIPGDEQSSKGAVFGLFLYMAAFGATWLPLPWLYPAELSPVRTRAKANAVSTCNNWLFNFAVVMFTPPMVAAIGWGTYLFFAAWNAFFIPVIWFFYPETANRSLEEIDLIFAKGYHEKISYVRASHELPKLSDDEIEAEAAKYQYSPETEAEVEKGHVAHPGSTSE

SEQ ID NO: 6645 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 6646 - protein, 645 aa, Pseudomonas syringae pv. tomato str. DC3000
MGQTRFATGRQLDLICLGRLGVDLYAQQVGARLEDVSSFAKYLGGSSANIAFGTARLGLRSAMLSRVGDDHMGRFLLESLAREGCDVSAVKRDPERLTAMVLLGLKDRETFPLVFYRENCADMALRAEDIDEQHIASSKALLITGTHFSTDQVFKASSQALDYAEKHNVKRVLDIDYRPVLWGLAGKADGETRFVADQKVSQHVQRILPRFDLIVGTEEEFLIAGGSTDLLGALRTVRELTAATLVVKLGPQGCTVIHGAIPARLEDGAIYPGVRVEVLNVLGAGDAFMSGFLSGWLTEASDERCCQLANACGGLVVSRHACAPAMPTPAELDYLFNSPEPITRPDQDVILQRLHQVSVPRKQWKQLFIFAFDHRGQLVELAQQAGRDLNSISQLKQLFVQAVERVEADLHQRGIEADVGLLADQRFGQDSLNTATGRGWWLARPVEVQGSRPLAFEHGRSIGSNLINWPQEQIVKCLVQYHPDDEPMLRLEQEAQIKALYDASKVSGHELLLEIIPPKDHPSAHPDVMLRALKRLYNLGIYPAWWKIEAQSTEVWQQLDELIQQRDPYCRGVVLLGLNAPVEELAAGFAQARDSHVCKGFAVGRTIFREPSRAWMAGEIDDATLVSQVQSTFSGLIESWRESRA

SEQ ID NO: 6647 - protein, 468 aa, Escherichia coli
MKKVNHWINGKNVAGNDYFLTTNPATGEVLADVASGGEAEINQAVATAKEAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGITAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKFAERANRVRVGDPTDPNTQVGALISQQHWEKVSGYIRLGIEEGATLLAGGPDKPSDLPAHLKGGNFLRPTVLADVDNRMRVAQEEIFGPVACLLPFKDEAEALRLANDVEYGLASYIWTQDVSKVLRLARGIEAGMVFVNTQFVRDLRHAFGGVKPRTGREGGGYSSKCSRK

SEQ ID NO: 6648 - protein, 356 aa, Magnaporthe grisea
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQENNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 6649 - protein, 216 aa, Oryza sativa (japonica cultivar-group)
MDEEEHEVYGQEIPEDGDMDGADVDMASGGDDAAKLQELDQMKRRLKEMEEEAAALRDMQAKVAKEMQGGPPGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRVPRFRRPMRYRPYF

SEQ ID NO: 6650 - protein, 133 aa, Triticum aestivum
  unsure (1)..(133): unsure at all Xaa locations
MAPTVMASSATSVAPFQGLKSTAGLPVXRRSNGASLGSVSNGGRIRCMXVWPIEGIKKFETLSYLPPLSTEALLKQVDYLIRSKWVPCLXFNKVGFIFREQNATPGYYHXRYXWTMXWKLPMFGXCTDPTQGD

SEQ ID NO: 6651 - protein, 187 aa, Saccharomyces cerevisiae
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 6652 - protein, 682 aa, Eremothecium gossypii
MYRVVIPLLLEPVSCPPVSFRCRKRSVAAAWPFPCRWHEALLNFCVKTTVYTGEEININNQRTTAGNTMEPLIEIRSRLRKSSQDLLQLKLYQSARWSSEALIGMCEGGVEDTTADEGSPLRNRRGKGDTGIQVSMDSEPFGERQYDLFLLASSLFDCKEYDRCAYFLRNEKHPRLKFLRLYSRFMSWDKKTQESSSDVLTKPADIAQKDPGVGTNVVDWIDERNVDTRKEANIQSQMVVDLGTGEKISITLILRELELYLVEQLANSKEPADVGYALLYYLRGILEKKQGLASEAIKSFVRSLELYPYNWTCWCELATCITRTDESLLLVKHLRDLFPANGERGDNAVMLRFFKISIFKDFGGDFDHFMDELDYLMGLFPNFSFLKSELALLNYHYMDYVNAELIFDEIVKLDPYRLDDLDIYSNILYVIQKPHKLAYLSQFAADLDAYRPETCCIIANYFSAKQQHEKAIMYFRRALTLNKTCTNAWTLMGHEFVEMKNSHAAIECYRRAVDINPCDFKAWYGLGQAYEVLDRHLYALYYLQKACSLKPLDKRMWQALANCYDKLDRPNQAIKCFQRASQLSNDQDITILYYLATLYERVQDAISCKNYMLKCIEVESANQGIILDECAKARLWLARHEVKHRNFTAAYNYASGVTHGTSQEIEAAIVIARECRKRMEYQ

SEQ ID NO: 6653 - protein, 538 aa, Triticum aestivum
MAMASRARTRWSALAASTLIQCFAGGSYCFGVYSPALKASQGYDQSALDAVAFFKDVGANVGVLSGLLAAWAPSGGRRRPWLVLLTGAALCAAGYLPMWLAVAGVVPAPLPLVCLYMLLAAQAQTFMNTADVVTAVENFPDRRGTVIGIMKGFLGLSGAILVQVQRTLRIDPGSFILMLAILPTAIALLLMYFVDVHSAHERYNKKFLDAFSLMAVTVAGFLMVVIICDQVFVISSAGQSVCFGILLLLILSPAAIVVRVQRTEPKQQEEPTPEEQTGLLLHEETAQQDSENASSSMALVGSNSQDMSSDKAENLNVVQAMCKLDFWLLFVAMACGMGSGLATVNNISQIGGSLGYTSRETSTLVSLWSIWNFSGRFGAGYVSDHFLRSRGVGRPFFIAATLLVMGVGHAIISSGFHASLYVGSVLVGLCYGSQWALMPSITSEIFGLNHFGTIFNTVAVASPVGSYILSVCVVGFIYDKESPQGELACAGKHCFALSFMIMACVCVFGSAVAFVLFVRTRKFYRRVIYARLLSFVDK

SEQ ID NO: 6654 - protein, 315 aa, Neurospora crassa
MPTGDADSNPRQPGVSLRERRRPSTASIASASRVFSSAADSLLESAKDVEHRIEDALLVLWDELPHWRRDNHFIHSGYRRTSNSFQKSFWSIFYLHNEFVNIWTHLLGAISFTFGGFFLYNAVAPRYASASESDVLVFTCFFLGAFCCLGMSATYHTLSNHSPEVAKWGNKLDYTGIVFLIVGSYVPTMYYGFFCYPALLTFYLSMICLLGLGCITISWFEHFRTPAWRPYRAMMFVGLGASGVVPILHALTFTSFTQLDELMGLRWVMLQGAMYIFGALLYAIFHVFVVLAAATHLHGMAKAFDYHHAVLGGTC

SEQ ID NO: 6655 - protein, 443 aa, Arabidopsis thaliana
MLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFGKSSV

SEQ ID NO: 6656 - protein, 449 aa, Phaeoschizochlamys mucosa
  unsure (1)..(449): unsure at all Xaa locations
SDRYESGVIPYAKMGYWDADYNVKTTDVLALFRITPQPGVDPVEAAAAVAGESSTATWTVVWTDLLTACDIYRAKAYRVDPVPGTTDQFFAYIAYECDLFEEGSLPNLTASIIGNVFGFKAVKALRLEDMRIPYAYLKTFQGPATGLIVERERLNCFGRPLLGATVKPKLGLSGKNYGRVVYEGLRGGLDFLKDDENINSQPFMRWRERYLYVMEGVNRASAATGETKGSYLNVTAPTMEEMYERADYAKSIGSIIVMIDLVIGYTAIQTMAIWARKADMILHLHRAGNSTYARQKNHGINFRVICKWMRMSGVDHIHAGTVVGKLEGDPLMVKGFYNILLLTTMEVNLPQGIFFDMDWASLRKXVPVASGGIHCGQMHQLVYYLGDDVVLQFGGGTIGHPDGIQAGATANRVALEAMILARNEGXDYFNEGPQILRXAAXMCGPLXTA

SEQ ID NO: 6657 - protein, 274 aa, Oryza sativa (japonica cultivar-group)
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQKPVAVPA

SEQ ID NO: 6658 - protein, 153 aa, Lycopersicon esculentum
GLSKKPKEHIVDIDAADVNNELAVLEYVEDIYNFYKLAETETRVHDYIDSQPEINEKMRAILIDWLIEVHHKFELNPETLYLTINIVDRYLTVETSSRRELQLLGISAMLIASKYEEIWAPEVNDFVCIADKTYSHDQVLAMEKQILGKLEWY

SEQ ID NO: 6659 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEREFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 6660 - protein, 556 aa, Arabidopsis thaliana
MSPLPIFHRLPHATFSSFLLSLSQAGSSKTSVAFLNAFKSEDIIARIGLWWQLIRAVVVVPVFKFLVLLCLVMSVMFFVEVMYMGIVVLYVKLFKRKPEKFYKWEAMEDDVECGSASYPMVLVQIPMYNEKEVCEQSIAAACKISWPSNRIIIQVLDDSTDPASKELVKKECDRWSKEGVNITFEIRDNRNGYKAGALREGMRHSYVKQCDYVAIFDADFQPDPDFLHRTVPFLIHNPKLALVQGRWEFVNAGQCMMTRLQEMSLSYHFTIEQQVGSSTFAFFGFNGTAGVWRISALNESGGWNDQTTVEDMDLAVRATLRGWKFLYIDDLKVKSELPCSFKALRSQQHRWTCGPANLLRKMAGQIIRSENVSLWKKWYMLYSFFFMRKIVAHILTFCFYCVILPATVLFPEVTVPKWAAFYLPSLITLLIAIGRLRSIHLLAFWVLFENAMSLLRAKALVMGLFETGRVQEWVVTEKLGDTLKTKLIPQVPNVRFRERVHLLELLVGAYLLFCGIYDIVYGKNTLYVYLLFQSVAFFVVGFGFVGKYVPASSYLA

SEQ ID NO: 6661 - protein, 296 aa, Leptospira interrogans serovar lai str. 56601
MPSNNASTKFYFFLVIAMISWGFAWPSAKLIVGTQHPNVIIFWRFLATAISLLPIVFYRKESFRLPNFKVCFQVIIGGILYTAYNQFFLLGLKNGLAGAGGVLVTTMNPIFTYVFVHTLQKKLPSIREGIGLLLGLVGGCILLRIWELNLNSLFNSGNIFFLLCAFSWAFLSINSHRAGQNVSPLLYSFYVFAIGTLLDFFIALPHGLENALNAGANFWFHILYLSVISTTFGTTVYFFASSKLGSRAASSFIFLVPATALLGSWIFLNENPSFTTTIGGTFAVLAVFLLNRNQDE

SEQ ID NO: 6662 - protein, 599 aa, Eremothecium gossypii
MLVRKLTLIGAALARAALALQQEDFVVNGELLPGVREIDRAEVPEMHAGLMPLEEDEDGRALFFWRMGEQCGKRCSNELIVWLNGGPGCSSMDGALMETGAFRVAEDGKLYLNSGSWHTRGTMLFVDQPVGTGFSRPGRDGRLRTELSQLADDFLLFMERYYAVFPEDRRRTLVLAGESYAGQYLPYFADAVVRRNAERAPEERYKLQNVMIGNGWVDPDLQSLSYVPFVSSRGLFGPETRNFQDILRDQEACQNAINHGPAKGFSHPECEGILPKLLSSIPGPDRPVQQCINMYDIRLRDVFPSCGMNWPADLPNVHKFFGTPGVLEALHVDPQVAGPWVECKSAVSEALVNAHSRPSVHLIPGLIEAGVKFVFFNGDQDVICNNMGVEMLIAELRWRGHMGFSNATENFDWYHSDADAKTLVAAGVVKRDGPVTFISVFNASHMVPFDVPRISRGIIDIERSATILGVKGDSRMLITVDTEEDVTLSTNAERNQQIRHNQLKRLNGDTRKFTIAVFGLTISSIIGVIVYFSMRLHYGAKIRAILTNPKSGTSSADDFSMDDEYTGTVMGDFHHGTHKKGQYYAVPDTDISSSELHSV

SEQ ID NO: 6663 - protein, 515 aa, Azotobacter vinelandii
MVSVMPSTLPPKRVSRNSLPDERCVDDLVLTGFMDFTLLKMRGIYQNGHGETQSRLPSRPPSPHLKVGLAARRASHVWCAGRPAYWPTSLGRFRAPTSFEEIMAELGKRRFARIDRLPPYVFNITAELKMAARRRGEDIIDFSMGNPDGAPPAHIVEKLVQVARREDTHGYSTSRGIPRLRRAISHWYRDRYAVEIDPDSEAIVTIGSKEGLAHLMLATLDHGDSVLVPNPSYPIHIYGAVIAGAQVRSVPLVPGMDFFAELERAIRETIPKPKMMILGFPSNPTAQCVELDFFERVVALARQYDILVVHDLAYADIVYDGWKAPSIMQVPGAKEVAVEFFTLSKSYNMAGWRIGFMVGNQELVGALARIKSYHDYGTFTPLQVAAIAALEGDQQCVRDIAEQYRERRNLLVKGLHEIGWMVEKPKASMYIWAKIPEPYAHLGSLEFAKKLLAEAKVCVSPGLGFGDYGDDHVRFALIENLDRTRQAIRGIKAMFRADGLLEVTSEKARKSDASH

SEQ ID NO: 6664 - protein, 339 aa, Talaromyces emersonii
MFATRQAFNLFQKRAFSASARQSSKVAILGAAGGIGQPLSLLMKLNPRVTELALYDIRGGPGVAADLSHINTNSTVTGYQPTPEGLRDALKGSEIVLIPAGVPRKRGMTRDDLFNTNASIVRDLAKAAADACPNANILVISNPVNSTVPIVAEVFKSKGVYNPKRLFGVTTLDVVRASRFISEVKNTDPANEEVTVVGGHSGVTIVPLISQSNHPDIEGETRDKLVNRIQFGGDEGVKAKDGAGSAALSMAFAGARSPSLCSSGQGVKGVVKPSFVDSPLYKDQGIDFFASRVELGPNGAEKVLPVGKVSPYEEKLLEAAFADLKKNIQKGIDFVKNNP

SEQ ID NO: 6665 - protein, 336 aa, Trichodesmium erythraeum IMS101
MKKPDKVVLIGVAGDSGCGKSTFLRRITDVFGPEFVTVICLDDYHSLDRKQRKETGITALDPRANNFDLMYEQIKALKNLESIDKPIYNHETGMIDPPEKIHPNHIIVIEGLHPLYDERVRELIDFSVYLDIGDEVKIAWKIKRDLAERGHRYEDVLASINARRPDFESYIDPQKVHADVVIQVLPTKLIPNDQEHKVLRVRLIQREGVKNFDPVYLFDEGSTINWIPCGRKLTCSYPGIKMFYGPDSYDGNEVSILEVDGNFDNLEEMIYVEGHLSNTSTKYYGEMTHAMMKHQDYPGSNNGSGLFQVLVGLKMRATYESLTATTLDEKVVAAVS

SEQ ID NO: 6666 - protein, 332 aa, Streptomyces carzinostaticus subsp. neocarzinostaticus
MGKRAAHIGLRALADLATPMAVRVAATLRVADHIAAGHRTAAEIASAAGAHADSLDRLLRHLVAVGLFTRDGQGVYGLTEFGEQLRDDHAAGKRKWLDMNSAVGRGDLGFVELAHSIRTGQPAYPVRYGTSFWEDLGSDPVLSASFDTLMSHHLELDYTGIAAKYDWAALGHVVDVGGGSGGLLSALLTAHEDLSGTVLDLQGPASAAHRRFLDTGLSGRAQVVVGSFFDPLPAGAGGYVLSAVLHDWDDLSAVAILRRCAEAAGSGGVVLVIEAVAGDEHAGTGMDLRMLTYFGGKERSLAELGELAAQAGLAVRAAHPISYVSIVEMTAL

SEQ ID NO: 6667 - protein, 239 aa, Bacillus amyloliquefaciens
MKRVLLILVTGLFMSLCGITSSVSAQTGGSFFEPFNSYNSGLWQKADGYSNGDMFNCTWRANNVSMTSSGEMRLALTSPSYNKFDCGENRSVQTYGYGLYEVRMKPAKNTGIVSSFFTYTGPTEGTPWDEIDIEFLGKDTTKVQFNYYTNGAGNHEKLPDLGFDAANAYHTYAFDWQPNSIKWYVDGQLKHTATTQIPAAPGKIMMNLWNGTGVDDWLGSYNGVNPLYAHYDWVRYTKK

SEQ ID NO: 6668 - protein, 73 aa, Bradyrhizobium japonicum
MKTAKDVLKSIKDNDVKYVDLRFTDPRGKWQHVTFDVSMIDEDIFAEGTMFDGSSIAGWKAINESDMCLMPDP

SEQ ID NO: 6669 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 6670 - protein, 516 aa, Escherichia coli CFT073
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 6671 - protein, 668 aa, Enterococcus faecalis V583
MLHKAEGFDRRKFTMAGILVAMGVVYGDIGTSPLYVMKAIVGDNGGLARVSESFILGSVSLIFWTLTILTTIKYVVIALNADNHGEGGIFSLYTLVRKKSKYLIIPAMIGGAALLADGVLTPAVTVTTAIEGLRGIPAFFERFGNDQTIIVVITLTIILILFSVQRFGTELVGKAFGPIMFLWFTFLGIIGLMNFSQDWTVIRALNPYYALQLLVSPENKLGLFILGNIFLATTGAEALYSDLGHVGKMNIRISWPYIKICLILNYLGQAAWLLTVKENPEMQALAEINPFFQMIPRGILVFGVVFATIAAVIASQALISGSYTLVSEAIKLKLLPRLKIIYPGSNIGQMYIPAVNLILWLACSAIVLAFRTSTHMEAAYGLSITITMLMTTILLLFYLLDKIPAWSAYLISLFFAAIEVVFFFSSAAKFFHGGYVAVGMAVFLLCIMIIWERGNEIKEATAEQVSLKKYVPQLKALKEDTSVPMYQTNVVFLTSDRVDGEINRNIIYSILDKQPKRANVYWFVNVQVTDEPFTQEYSVDMLGTDFIVQVQLYLGFHISQEVNVYLRQIVHDLMKTGRLPKQPQRYSLTPGREVGDFQFVLIQEELSNVSELKKWDRQIMQAKLAIKNLTTSPESWFGLEYSEVKYESVPLIIGPQRKTHLVERKNRS

SEQ ID NO: 6672 - protein, 354 aa, Synechocystis sp. PCC 6803
MTGSFFCYLFPRSFSMLKIGINGFGRIGRLVARIAMANPQVTLVGINDLVPASNLAYLFKYDSTHGSYGGTVVAKEEGIVIDDQFIPCFSQRDPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 6673 - protein, 466 aa, Zea mays
  unsure (1)..(466): unsure at all Xaa locations
MASRNHNAAAPQLHHHNRAGVPALGKTKAVPARPDALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKDAGXAHSTAPESKLRVVYKKYSQRAVRKGPAWVHPQRRSASERRLLYPCLPIACFRGSGDGRRV

SEQ ID NO: 6674 - protein, 302 aa, Pseudomonas aeruginosa UCBPP-PA14
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLLSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 6675 - protein, 404 aa, Vibrio vulnificus CMCP6
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDERHRVHSFVEKPQNPPHLPNDPERSLVSMGIYIFSMEVLQQALIEDADDDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSIIANGVINSGGSVQHSIVSSNVRINDSATVVDSIIFDDVEIGEGCQLVNCIIDKHVKVPPYTQIGLNRLEDAQRFKISENGIVVVPESYQF

SEQ ID NO: 6676 - protein, 483 aa, Brucella suis 1330
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGVLAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKR

SEQ ID NO: 6677 - protein, 303 aa, Zea mays
  unsure (1)..(303): unsure at all Xaa locations
MAAAPRGGPASDDDRSVAADSWSIKSDYGSTLDDDQRYSDTAEVLLASSSASSVAAPSTTVAVHPSSDFSFDKDVHDSSYVEPPLLGLQNFQDGAYAEDLANFHERSHADDWFGTDIMDIRVGWTKNLCSSRDLPSCSVLDIGTGSGRLLQQLAXXGFSDLTGIDYSESAIELARSLAIGDGXFEHINFLVDDGLESELERRFELVMDEGTLDAIGLHPDGPVKRMMYWQSVDSLVSRGGILXTKDELVQEVENFNQRKLGAVGSGSEGLPASEAAVVSYLDHVQSYPSVDSSCITPVAFLHK

SEQ ID NO: 6678 - protein, 452 aa, Nostoc punctiforme
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 6679 - protein, 576 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKS

SEQ ID NO: 6680 - protein, 172 aa, Synechocystis sp. PCC 6803
MDLKALIRDIPDFPKPGIMFRDITTLLNSPEGLRYTIDSLVEQCESQELVPDHVVGMESRGFLFGMPLAYQMNAGFIPVRKPGKLPAPVHRVEYDLEYGKDSLEIHQDAVAPHHRVLIVDDLIATGGTAKATAELLTKLGCEVLGFAFIIELAALNGRQCLPDLPIISLVEY

SEQ ID NO: 6681 - protein, 572 aa, Salmonella typhimurium LT2
MKQTVAAFIAKTLEQAGVKQIWGVTGDSLNGLSDSLNRMGTIEWMPTRHEEVAAFAAGAQAQLTGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPENAVTHWYHAPLPVVTPAEEELKKLAQLLRYSSNIALMCGSGCAGAHEELVALAAKLKAPIVHALRGKEHVEYDNPYDVGMTGLIGFSSGFHTMMNADTLILLGTQFPYRAFYPSDAKIIQIDINPGSIGAHSKVDMALVGDIKATLRALLPLVEEKSNRKFLDKALEHYRDARKGLDDLAKLSDKAIHPQYLAQQISHFAADDAIFTCDVGTPTVWAARYLKMNGKRRLLGSFNHGSMANAMPQALGAQATAPGRQVIAMCGDGGFSMLMGDFLSVVQMKLPIKIVVFNNSVLGFVAMEMKAGGYLTDGTELHDTNFARIAEACGITGIRVEKAADVDGALQRAFSIDGPVLVDVVVAKEELAIPPQIKLEQAKGFSLYMLRAIISGRGDEVIELAKTNWLR

SEQ ID NO: 6682 - protein, 679 aa, Geobacter metallireducens
MKISKHPISHALTSFNETAKETKEEPQKKRGGKVHHLPASIWKKRDVETTSPLDQAIKRSQEFFLREQLPAGYWWAELESNVTITAEYVILFHFMGLVNRDKDRKMATYLLSKQTEEGCWCIWHGGPGDLSTTIEAYFALKLAGYPADHPAMQKARTFILGKGGILKARVFTKIFLALFGEFSWLGVPSMPIEMMLLPNGFTFNLYEFSSWSRATIIPLSIVMAERPVRKLPPWARVQELYVRPPRPMDYTFTKEDGILTWKNIFIGIDHILKVYEASPIRPGMKKAMAIAEQWVLDHQEPTGDWGGIQPAMLNSVLALHCLGYANDHPAVAKGLQALANFCIESDDEIVLQSCISPVWDTALALMAMVDSEVPTDHPALVKAAQWLLDREVRKVGDWKIKAPNLEPGGWAFEFQNDWYPDVDDSGIVMMAIKDVKVKDSKAKAEAIQRGIAWCIGMQSKNGGWGAFDKDNTKHILNKIPFADLEALIDPPTADLTGRMLELMGTFGYPKDHPAAVRALQFVKENQEPDGPWWGRWGVNYIYGTWSVLCGLKAYGEDMGQPYVRKAVEWLAAHQNPDGGWGECCESYCDQKLAGTGPSTASQTGWALLSMLAAGDVDHPAVARGIRYLIETQQPDGTWDEDQFTGTGFPKYFMIKYHIYRNCFPLMAMGRYRALKGHKG

SEQ ID NO: 6683 - protein, 174 aa, Triticum aestivum; identical to SEQ ID NO: 1921

SEQ ID NO: 6684 - protein, 311 aa, Arabidopsis thaliana
MRTGKRNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKRLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 6685 - protein, 627 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDARGPCTRVGRRTSTRPSRRTSRSSISACRATRSRCRRRSGSFRARAGSSRRACSRDVAGAGGRISVGEGAHGPAGDHVPRQAHAAQHLRVWLVGSGDRRGALDCDEPPAGVPAARAGARARAVRDRRASAPAPPREGVGGSSTRSTGRCTGLRSCRCTRSAAAEIRALDWLLERQAGDGSWGGIQPPWFYALIGLKILDMTQHPAFIKGWEGLELYGVELDYGGWMFQASISPVWDTGLAVLALPAGLPADHDRLVKAGEWLLDRQITVPGDWAVKRPNLKPGGFAFQFDNVYYPDVDDTAVVVWALNTLRLPDEPQRDAMTKGFRWIVGMQSSNGGWGAYDVDNTSDLPNHIPFCDFGEVTDPPSEDLTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTASPGDFYLGYTMYRHVFPTLALGRYKQAIERR

SEQ ID NO: 6686 - protein, 105 aa, Glycine max
  unsure (1)..(105): unsure at all Xaa locations
LGLVVGKKDFRPDFWSALEELSPQSGPMMHNSSQVDLDYMXEKKFCKEQDLVFVCAHSEEGPSVXYTPPKWGHYVRYLTASLSVSFWWRQGESSDASQRYRFISS

SEQ ID NO: 6687 - protein, 194 aa, Methanosarcina mazei Goe1
MNRKAGAVVLICLFAGVILVPGCINKQHVEQPVNNESSNAGKGDESVDIQVIKVFSSAFESNSTIPRKYTCNGENINPPLEFADIPEETESLVLIMDDPDSPMNPFTHWIVWNIEPVAKIEEDSIPGIEGMNNFRKIGYGGPCPSSGTHRYFFKVYALDRKLELKAGSGRKELESEMIGHIIAEGELMGKYGKT

SEQ ID NO: 6688 - protein, 560 aa, Streptococcus agalactiae NEM316
MTESHNQYGADLIVDSLINHDVKYVFGIPGAKIDRVFDTLEDKGPELIVARHEQNATFMAQAVGRITGEPGVVIATSGPGISNLATGLVTATDEGDAVLAIGGQVKRGDLLKRAHQSMNNVAMLEPITKYSAEVHDPNTLSETVANAYRLAKSGKPGASFISIPQDVTDSPVSVKAIKPLSAPKLGSASVLDINYLAQAINNAVLPVLLLGNGASSEGVTAAVRRLLDAVKLPVVETFQGAGIVSRELEDETFFGRVGLFRNQPGDMLLKRADLVIAIGYDPIEYEARNWNAEISARIIVIDVEQAEIDTYFQPERELIGDMAHTLYLLLPAIKGYELPEGSKEYLKGLRNNIENVSDVKFDRDSAHGLVHPLDLIDVLQENTTDDMTVTVDVGSHYIWMARYFKSYEARHLLFSNGMQTLGVALPWAISAALLRPNTKVISVSGDGGFLFSAQELETAVRLHLPIVHIIWNDGKYNMVEFQEEMKYGRSSGVDFGPVDFVKYAESFGAKGYRVDSKDSFEETLKQALIDAENGPVLIDVPIDYKDNVTLGETILPDEFY

SEQ ID NO: 6689 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 6690 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERCSARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 6691 - protein, 375 aa, Bifidobacterium longum NCC2705
MTENTHHDPAALDKLAEPFTVLPNDNPASDEKRQSLIDKPAFGQVFSDNMTHMTWTKGEGWSDRRVEPYAPLKMDPGASVLHYAQECFEGLKAYRHADGSTWLFRPDANAERFQNSAKRLYLPELPIDDFLGSVAALVKRDANWVPSRREYTLYMRPFMFASEPFLGVRAPQEVDYCVIASPSGPYFPGGVKPVSIWVEDKWFRTGPGGTGFAKCGGNYAASLLGEYKGVENGCEQVCFVDAATKTYLEELGGMNMMAVHKDGHVETPSLTGNILPGVTRRSLIQLLQDKGHDVVETMIALDQLLEDIKSGEVTEVFACGTAAIITPIGRFKSEKFDVAVADGGSGKLTCELRDELLGIQLGEVEDPHNWMWKVC

SEQ ID NO: 6692 - protein, 251 aa, Microbulbifer degradans 2-40
MGVKSKIVIGNWKMNGSAELVESFTRTMLDNQAAYAGIRVVLCPPFTLLQAMADALEGGPILLGAQNVSEFEQGAHTGEISAPMLASMGTKMVIIGHSERRASRGENDRIIAAKVKQALSVGMLPVLCVGETAEEKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 6693 - protein, 264 aa, Desulfitobacterium hafniense
MLPIVDKPTIQYIVEEAVHSGIEDIIIVTGRNKRAIEDHFDRSIELETFLQKSEKEELLDMVQDIARMVDIYYVRQKEALGLGHAIYCARKFIGNEPFAVLLGDDIIHSEVPCLRQMMHVYERHGASIVGVQQVPLEDTSKYGIVDAVPLDDSLYRALDLVEKPQPEDAPEARLAIMGRYILNPEIFGILESIPPGKGGEIQLTDGLKELARFQEILAYEFDGQRYDVGDKLGFVQATIEYALRREDLAEPLMRYLKQRIESDE

SEQ ID NO: 6694 - protein, 328 aa, Oryza sativa (japonica cultivar-group)
MALEAVVYSHGGHFGGYGGGLMGGAPAAPWDVFAAAGGGGSWDDPGLFAAEASLDVIQGVDEWEVDQDQHASSSSKVAARPPVKAAAAAGKRKRRRAKAAKNREEIESQRMTHIAVERNRRRQMNEYLAVLRSLMPPSYAQRGDQASIVGGAINYVRELEQLLQTLEARRTIKDHIDGGAGESPSPFAGFFAFPQYSTATSGHGGGGDAHSRIVVKPAETTTTAAGGGAGAAIADIEASMVEGHASVKVQARRRPRQLLKLVAGLHQLGLTTLHLNVTTVAAMAMYSFSLKVEDGCKLGSVEEIATAVHEILERMQEEQAFADAKTSL

SEQ ID NO: 6695 - protein, 361 aa, Schedonorus arundinaceus
MGSVDASEKTITGWAARDATGHLSPYTYNLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGLTSQIEVVKMDYLNQALERLERNDVRYRFVVDVAGSNIDDTAA

SEQ ID NO: 6696 - protein, 402 aa, Schizosaccharomyces pombe
MNSNNKRVALQEISNYVSKSLNVKGWVNAQVREISLQNGCSPSDKHFPSQSWHGISSIEESQIQKDYDSFLASPLEEEIVFTEKQLLVDLDVCSISNVQSPNCSVSEFGIAIEESNDNCAEEDEEEELQMRYSADESVSVEYAKEILSHMEKLEIRFMPDYRHMSAQPYYVTEMRASVINWIVGVHTCINLLPESLFLSINVLDRFLSLQNVPASKMKLCGATALFIACKYEEIHPPTVKDLEIVLEGEWIGEDICGMEKYMLMVLQYQLGWPGPVSFLRLLTIVNKWESQLRIMIKYFLEVSLVEQRFSSLRASQLVATCAYTGQSILQEENWSNTLPQITGYDYMSLVSYVHLLLKCLENPFDHHYAIYSKYATPYFHGISRQVHDWIATNTNLMAMDGS

SEQ ID NO: 6697 - protein, 331 aa, Streptococcus mutans UA159
MARKILEVIIAMLSKKQYLDMFLKMQRIRDVDTKLNKLVRRGFVQGMTHFSVGEEAASVGAIQGLTDQDIIFSNHRGHGQTIAKGIDIPAMFAELAGKATGSSKGRGGSMHLANLEKGNYGTNGIVGGGYALAVGAALTQQYDNTGNIVVAFSGDSATNEGSFHESVNLAAVWNLPVIFFIINNRYGISTDINYSTKISHLYLRADAYGIPGHYVEDGNDVIAVYEKMQEVIDYVRSGNGPALVEVESYRWFGHSTADAGAYRTKEEVDAWKAKDPLKKYRTYLTENKIATDEELDMIEKEVAQEIEDAVKFAQDSPEPELSVAFEDVWVD

SEQ ID NO: 6698 - protein, 574 aa, Escherichia coli K12
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGMVLPELKDIQKVSRAIAFAVGKMAQQQGVAVKTSAEALQQAIDDNFWQAEYRDYRRTSI

SEQ ID NO: 6699 - protein, 92 aa, Vigna radiata var. radiata
MGFRLPGIRKTLSARNEASSKVLDAPKGYLAVYVGENMKRFVIPVSHLNQPLFQDLLSQAEEEFGYDHPMGGLTIPCSEDLFQHITSCLSAQ

SEQ ID NO: 6700 - protein, 374 aa, Spinacia oleracea
MMQPLLTIPPPLPTTSLFDTSFLKHEDNIPSQFIWPDDEKPCSETPPELEVPPIDLGGFLSGDPVAVSKATTLANEACKWHGFFLIVNHDIYFELLVKAHEAMDYFFSQPFSQKQKALRKQGDHCGYASSFLGRFATKLPWKETLSFRYYDDDDDKSSKMVQNYISNLMGTDFQEFGRVYQEYCKAMSKLSLGIMELLGMSLGVGRNYFREFFKGNDSIIRLNYYPPCQKPELTLGTGPHCDPTSLTILHQDHVGGLEVFVDQKWYSIRPNQKAFVVNIGDTFMALSNGKYKSCLHRAVVNSKTPRKSVAFFLCPRGNKVIRPPIELGHPRVYPDFTWPLLLEFTQKHYRADTKTLDSFTKWLQKRSTEDERVK

SEQ ID NO: 6701 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 6702 - protein, 492 aa, Triticum aestivum; identical to SEQ ID NO: 4908

SEQ ID NO: 6703 - protein, 295 aa, Zea mays
  unsure (1)..(295): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLXKSIIKKKYGQDATKRWGNERXGFAPNIQENKEGXLELLKAAIEKAGXYTGKVVIGMDVAASEFFGEKDKTYDLNFKEENNDGSNKISGDSLKDLYK

SEQ ID NO: 6704 - protein, 234 aa, Oryza sativa
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKL

SEQ ID NO: 6705 - protein, 194 aa, Ranunculus acris
HEMSVLCDADVALIVFSIKGKLTEYSTNDSMESILERYERYSSSCKELPATDPESQECLFRDYNKLKSKVEALQKSQRHLKGEEIGGLGVKELQALEQQLDTSLRQIRSRKNQLMNGSITELHRSSKALHEENVNLKKQAKEMELALSVYKKHNQAPLNVSGTSTQSSETQGEGDVVQPLRAKTLMPPWMLNHL

SEQ ID NO: 6706 - protein, 202 aa, Zea mays
CIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRYCAMGLGLVGLDFRGLLPPIFEDAVLNLFSKNMSMAVENFQVVLDSHRWVPMPSVGFVANGVVDDTSDDVTPPSVLMEHPPLAVFVN

SEQ ID NO: 6707 - protein, 297 aa, Shewanella oneidensis MR-1
MAFHHAQHSHSLNQSLSELNGDINVSFEFFPPSTPEMEQILWNSIRRLEPLNPKFVSVTYGANSGVRDRTHGVIERIQQETNLVAAPHLTLVDASDEELLELAKHYWKSGIRDIVALRGDLPAGSPKPTRFAVDLVRLLRSVADFDISVAAYPEVHPDAANAQADLINLKRKIDAGASRAITQFFFDVESYLRFRDRCVAAGIDVEIVPGILPVTNFTQLKRFAGMTNVSLPSWLHKQFDGLENDAGTRQLVGANVAIDMVKVLSREGVKDFHFYTLNRAELTYAICHTLGVRPKAV

SEQ ID NO: 6708 - protein, 150 aa, Glycine max
  unsure (1)..(150): unsure at all Xaa locations
MSTTVQRTPRSSRQSLFFQDLASPVSARRGKFSSPSQAAAVSSLWRENFGSSDLPPPPVFTLEDRSDFSPESGILDYQISPETKSDTKTXPIQPQNKGFSTPGKSNLRRPHSLALERGQKNQRGPPSLECGPPPPGKRGGKKKRGKKSPR

SEQ ID NO: 6709 - protein, 198 aa, Zea mays
  unsure (1)..(198): unsure at all Xaa locations
MASSMLSSAAVVTSPAQATMGAPFTGLKSSAAFPVTRKANNDITSIASNGGRVSCMKVCPPAAKKKFETLSYLPDLTELELGXGEVDYLLRNKWIPCVEIRCWKHGILCNREHGSTPRNTTRARYWTMWEAFPLFRMALNSWLQGVERKTPKKGRNREVTPKTLPLHQGILRDFNTTTRPRPQGDSSFQSPQTSPHKL

SEQ ID NO: 6710 - protein, 634 aa, Brucella melitensis 16M
MSKRLDLITIGRSSVDLYGAQIGGLLEDMASFNKYVGGSPTNIATGTARLGLRSALITRVGDEHMGRFLLRELEREGVDTRGIVTDPERLTALVILGIRDQQHFPLIFYRENCADMALCEDDIDPDFIAEARCVLATGTHLSHPRTEAAVLKALRLARENGSRTALDIDYRPNLWGLSGHGDGENRFIESAAVTAKLQSTLHLFDLIVGTEEEFHIAGGSTDTLEALKAVRRVTKAALVCKRGPMGAVVFEGDIPDDLDKGQSGQGFPIEVFNVLGAGDGFMSGLLRGWLKGEDWPTSLKFANACGAFAVSRHGCTPAYPSWEELQFFLQRGIRNKALRKDAELEQVHWSTNRNGTWPHMRVFAFDHRIQLEEMAAEAGASTDKIGEFKQLCLDAALKVAGGAQGYGILCDGRLGRDALYRAAGTGLWIGRPAEWPGSRPLKLEPELGPDCGGLMEWPVEHVVKLLCFYHPDDPAEMRAGQEETVQRLFTAARRNRLEFLLEIIPSKAGPVDDMTTARVIERFYEIGVYPDWWKLEPLKTKAAWANACDAITRNDPHTRGIVVLGLDAPAEELEQSLGIAAGFDLVKGFAVGRTIFAEAARKWLSGTIDDAQAIAEMAARYQSLCDVWDKAHAY

SEQ ID NO: 6711 - protein, 324 aa, Eremothecium gossypii
MVESAVLSNPVPGNSAAIPIESPRSDEQLADTEDSSWEQDMSSDSKGDQDEQSSYNSLDSTTPVSQPLSKDRKHAKQVELDSRSVFVSSITPEATAEMLEEHFKDVGVISRITILYNKKTGEPKGYAYIQFESISSVEKALQLDGSSFNGNTISVAKKRTNLPGFNRPFNYYPYQQFHAHGNGRYHHPQSHHPHPQQHQFFYGNQWQNGYPHAHWNYGAYGGAYTPYKNVNFYNSYRFQQQGQHLPQMIPNENSRAHLREGRAGTRGNKGGNPNSSRKSRQTVGPSKTNDAKLMNDPPVSNSTSHSVNSVSTSATTSETGVKRE

SEQ ID NO: 6712 - protein, 195 aa, Zea mays
LSNVLNSIILVCSENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPVIEGQKWSATKWIHVRSFDLTVKQPGPSDGCEDDNVLCPQWAAVGECAKNPNYMVGTKEAPGFCRKSCKVCAE

SEQ ID NO: 6713 - protein, 289 aa, Zea mays
MHSHSCRGLLIPSLSARGKYPLISSHALLPRLLLLPHPRPPPPLRQPRHEPTRKLPARPPLPGINQTSRPSSFPSNQVHFHSLSTLSLVSGGRWPRLPFPVALMAPSAALAPVAFRSAFSTPLASNPTRNRINIEGAFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMSDLAQSLGMPAGLGDGLK

SEQ ID NO: 6714 - protein, 334 aa, Streptomyces avermitilis MA-4680
MTVRVGINGFGRIGRNVFRAAATRGADLEIVAVNDLGDVATMAHLLAYDSILGRFPEEVTAEPGAIRAGDTTVKVLAERDPAALPWGDLGVDVVIESTGIFTDAAKARAHVDGGAKKVIIAAPASNEDVTVVLGVNQDAYDPERHTIISNASCTTNCLGVLAKVLHDAVGIESGMMTTVHAYTQDQNLQDAPHKDLRRARAAGLNIVPTSSGAAKAIGLVLPELQGRLDAFALRVPVPTGSVTDLTVTASRSTTVEEVKEAYAKAAAGAYKGLLSYTEAPIVSTDIAGDPASCVFDAELTRVLGSQVKVVGWYDNEWGYSNRLIDLALLVGDTL

SEQ ID NO: 6715 - protein, 316 aa, Zea mays
MARDGGSRGSPGAERRRVALRALLASGGAEAEAARTSSKGLLRGLRCTSAAASQAIAPEIPRPPADWRGLGCAAAAQAHAPAAAVEAARPTADWRRLGCAAGAAPAVQAQAPRRSEEWRVRRRRNERERRKARAGGVSGGGGASAGMGVGGDVWCTPGIPFAAEASSVDCVVAPHHTVAARRRAEADRPRREMMFQTRMLLGRMGIYDQYQDWRLDVDNMTYEELLDLEDRIGYVSTGLREDEIIQSLRMVKYSAFNPRHFSTEMDRRCSICQEEFEVHEETGKLSCGHSYHVHCIKQWLSRKNACPVCKTTVSKT

SEQ ID NO: 6716 - protein, 460 aa, Schizoseris sp.
WDPEYVIKETDVLALFRVSPQPGVDPVEASAAVAGESSTATWTVVWTDLLTACDLYRAKAYKVDPVPNATDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIVMIDLVIGYTAIQSMGIWARKNDMILHLHRAGNSTYSRQKIHGMNFRVICKWMRMAGVDHIHAGTVVGKLEGDPKMIKGFYDTLLQPFLEVNLPEGIFFKQDWASLRKVTPVASGGIHCGQMHQLLDYLGNDVVLQFGGGTIGHPDGIQAGATANRVALEAIVIARNEGRDYVKEGPQILRDAAKTCGPLQTALDLWKDITFNYTSTDTADFVETPTANV

SEQ ID NO: 6717 - protein, 276 aa, Medicago truncatula
MWILLSCVFVGGRPATFNQDFHVTWSEPHIKQIDQGRTIQLTLDQGSGCGFASKVKYLFGRVSMKIKLVPGDSAGTVTAFYMNSDTDSVRDELDFEFLGNRTGQPYTVQTNIYAHGKGDREQRVNLWFDPSADFHTYSILWNHHHIVFYVDEVPIRVYKNNEAKGIPYPKMQAMGVFSTLWEADNWATRGGLEKINWSKAPFYAYYKDFDIEGCAIPGPTTCSTNPKNWWEGVEYQALSAIEARRYRWVRMNHVIYDYCQDKSRYPMTPHECLSGI

SEQ ID NO: 6718 - protein, 294 aa, Zea mays
MRNPPGRHLLCLSSRAVRSSSSSSALGPGPGAVTSAASPRPRAIAPGRPLRASSPSPPYAVAAAAYVEDGDWEEVVAGGPGTGEMEEEQDYRVVFWSPPTIDEVTGAVTSIQQVFENPLGLDSDTTDRQTTLLSASGHSSGNSSGSDDWIEPAAYVLNSTALLSREHRNVVDAFRLLQKDPTVQKMVMSLSCDKAVWNAVMNNEAVQDFRRSLHDGKENDRNENTGGPAEVFKWILESAQAKIFEFLENVQKIINMLIHTPEDDDNPDGYSDAVKVSFMLTVFVFIVVAIARIK

SEQ ID NO: 6719 - protein, 366 aa, Corynebacterium glutamicum ATCC 13032
MTKITLSDLPLREELRGEHAYGAPQLNVDIRLNTNENPYPPSEALVADLVATVDKIATELNRYPERDAVELRDELAAYITKQTGVAVTRDNLWAANGSNEILQQLLQAFGGPGRTALGFQPSYSMHPILAKGTHTEFIAVSRGADFRIDMDVALEEIRAKQPDIVFVTTPNNPTGDVTSLDDVERIINVAPGIVIVDEAYAEFSPSPSATTLLEKYPTKLVVSRTMSKAFDFAGGRLGYFVANPAFIDAVMLVRLPYHLSALSQAAAIVALRHSADTLGTVEKLSVERVRVAARLEELGYAVVPSESNFVFFGDFSDQHAAWQAFLDRGVLIRDVGIAGHLRTTIGVPEENDAFLDAAAEIIKLNL

SEQ ID NO: 6720 - protein, 352 aa, Thermoproteus tenax
MFGLVLAGGEGSRLRPFTFSTPKHLIPLLGRAMIEYPIVHLAEAGVSEVGVVVGYMGHLIQEHLGDGSRLGVRVRYFWQERRLGIAHAISLALPEIKGPFVVYLGDNILAGGIKRHVRAFLEGDFDVYILLARVPDPSRFGVAVLRDGRVVRLVEKPREPVSDLAVVGVYMFRDPEDVARAFSSLKPSWRGEYEVTDLIQWFIDRGRRVGFDFVDGWWKDVGTPEGLLEAVYLLLDHAEARVEGEVRGEVVGRVVVEKGAVVEGRVFGPAYVGPGAYVGRGAVVEHYVSLESGARLASGGASRSLLLNEAEVEVGGLRLVDSVLGRRSVVRSRRDLRGEARLIISDFSRVEL

SEQ ID NO: 6721 - protein, 472 aa, Arabidopsis thaliana
MALHLRSSFSSKSTLLNILRHNLGFGSRSHVTRHIRQILPHDPPLRGSQNPISRLCNTMAEPETLSSFVQHEYANNHQVMDFPGGKVAFTPEIQFISESDKERVPCYRVLDDNGQLITNSQFVQVSEEVAVKIYSDMVTLQIMDNIFYEAQRQGRLSFYATAIGEEAINIASAAALTPQDVIFPQYREPGVLLWRGFTLQEFANQCFGNKSDYGKGRQMPVHYGSNKLNYFTVSATIATQLPNAVGAAYSLKMDKKDACAVTYFGDGGTSEGDFHAALNIAAVMEAPVLFICRNNGWAISTPTSDQFRSDGVVVKGRAYGIRSIRVDGNDALAMYSAVHTAREMAIREQRPILIEALTYRVGHHSTSDDSTRYRSAGEIEWWNKARNPLSRFRTWIESNGWWSDKTESDLRSRIKKEMLEALRVAEKTEKPNLQNMFSDVYDVPPSNLREQELLVRQTINSHPQDYPSDVPL

SEQ ID NO: 6722 - protein, 357 aa, Corynebacterium efficiens YS-314
MCQTIVSTPASRVEFMIRADLTDIPTYVPGKNLGDALKLSSNEVAFPPLPAAVSAITEAATGANRYPDMGAVELRGVLADHLELTPEQITVGCGSSALCQQLVQATCAAGDEVIFPWRSFEAYPIFARVAGATAVPIPLLPDTQGHDLEGMLDAITDRTRLIFLCNPNNPSGTTFTEEQFEAFMQRVPADVVVGLDEAYFEFNRAEDSPVSTEAVQRYPNVIGLRTFSKAYGLAGVRVGYAFGNPELIGAMNKVAIPFAVSSLAQAAAIASLNAADELLERTEEVVTERERVAQVVGAAPSQANFVWLPGEGAAELAGRLAEHGVVIRAFPEGARITVTNAAETDRLIRAWEAVHHG

SEQ ID NO: 6723 - protein, 396 aa, ASPERGILLUS NIDULANS FGSC A4
MARLLNRWHLPALVRRHYSSRFQSLRIEKTQSPKPLPDSTELQFGRSFTGKYPSQTRNHILKLEWTTTQGWSDAQITPYDNLRLDPASCVLHYAFTCFEGMKAYKDPHGNARLFRPEENLARLNRSAARLALPTFEESGVLEFLAKYVDLEKRFIPHLPGHSLYLRPTLLGTDASISVSRPRSALLFVIASPMGDYFANGMKAVTLQATRSPVRAWPGGVGEFKVGGNYAPSIVPQEEAAEAGSQQNLWLLADRESGEEFVTEAGTMNLFVVWVSSSTGKKELVTPPLDGTILPGVTRMSILELARERLEGDRSGIEVVERRITMRELAAASKEGRLLEVFGAGTAVVVSPVRSIRWGDQCISCGLRDGEEAGPMSLQMKTWLEEVQYGLVEHPWR

SEQ ID NO: 6724 - protein, 643 aa, Oryza sativa
MGVATVTELRQSFSGKRALRPTLTSRHANEWPPTDVSSDLTVEVGTSSFALHKFPLVSRSGKIRRAVAEAKDGKLARLGLHGTPGGAAAFELAAKFCYGVGVDVTVGNVAMLRCAAHYLQMTEDFSDKNLELRAEAFLRDAVLPSIAGSVAVLRSCEALLPAAEDVNLVPRLIAAIANNVCKEQLTSGLSKLDQLKPPPPPQADSPGDWWGKSVAGLGLDFFQRLLSAVKSKGLKQETVTRILINYAQNSLHGLMARDIAAAAKCGGGGGDTDAVKKQRAVVETIVGLLPAQSKKSPVPMAFLSGLLKTAMAASASSICRADLEKRIGMQLDQAILEDILVAAGPVSAAAAAAAVEHTLYDTDVVARIFAVFLNLDDDSNDEDAVVVGGGCGAFDYDSPRSPKQSLLVKASKLLDSYLAEIALDSNLLPSKFISLAELLPDHARLVTDGLYRAVDIFLKVHPNIKEAERYRMCKAIDCQRLTPDACSHAAQNERLPVQMAVQVLYFEQLRLRSAIQASAHDAALFFGCAAAAAAPRSGSGVGSGAMSPRDSYASVRRENRELKLEVARMRMRLTDLEKDQVSMRRELVRVGPANRLLRGLARRLGSLFHFRGAAAEPGLQQLGAKATADAKVLFQRRRRHSIS

SEQ ID NO: 6725 - protein, 369 aa, Haemophilus somnus 129PT
MQYINIANEGVKSLSPYHAGKPIEELERELGISNIIKLASNENPFGFPESAKQAIQRQLNDLTRYPDSNGFELKQVISKKFGLQPEQITLGNGSNDLLELIAHTFASETDEIIYSQYAFIVYPLVTKAINAVAREIPAKNWGHDLDAFLQAINHKTKLIYIANPNNPTGNFLTEHEIDHFLAQVPEKVLVVLDEAYTEFTDEKERLNSFKLLQKYPNLIVSRSLSKAYGLAGLRIGYAVSNPEIADLLNRVRQPFNCNVLALVSAVAVMQDDAFVEKVAENNRIEMVRYENFCRQQKLDYIPSKGNFITIDFKRPANEIYQALLHKGVIVRPIAGYGMPNHLRVSIGLPKENDKFFDALVKVLGEVFVG

SEQ ID NO: 6726 - protein, 125 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 6727 - protein, 113 aa, Zea luxurians
MGRRACCAKEGVKRGAWTSKEDDALAAYVKAHGEGKWREVPQKAGLRRCGKSCRLRWLNYLRPNIRRGNISYDEEDLIIRLHRILGNRWSLIAGRLPGRTDNEIKNYWNSTLV

SEQ ID NO: 6728 - protein, 488 aa, Eremothecium gossypii
MVHLGPKKPPTRKGSMADVPKTLVEQIASFERIFTVSAEKLQEITKHFVTELDKGLSKKGGNIPMIPGWVMDYPTGNETGDYLAIDLGGTNLRVVLVKLLGNHQFDTTQSKYRLPNRMRTTQNASELWDFIAESLKDFLEEQFPEGVHQTLPLGFTFSYPASQDKINMGILQRWTKGFDIPGVEGHDVVPMLQESLRKVNVPIEVVALINDTTGTLVASLYTDAETKMGVIFGTGVNGAYYDVVKDIEKLEGRLPEDIPPESAMAINCEYGSFDNEHLVLPRTKYDILIDEQSPRPGQQAFEKMTSGYYLGEVLRLALLDLHGQGLIFQGQDISKLETPYVMDTSFPARIEDDPFENLEETDDLFKDNLDIDTTRPERKLIRKLSEMIGNRAARLSVCGIAAICQKRGYETAHIAADGSVFNKYPGFQTRAAEGLRDIYGWEHSSSQDYPIKIVAAEDGSGAGAAVIAALTTKRLAAGKSVGLPEAQN

SEQ ID NO: 6729 - protein, 165 aa, Rhizobium sp. NM349
MFADGVMFDGSSIAGWKAINESDMVLMPDPATAHVDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVV

SEQ ID NO: 6730 - protein, 679 aa, Arabidopsis thaliana
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRSQPLQIKVSSSELSVLDEEKEEEVVKGEAEPNKDSVVSKAEPVKKPRPCELYVCNIPRSYDIAQLLDMFQPFGTVISVEVVSRNPQTGESRGSGYVTMGSINSAKIAIASLDGTVRARETKKQEVGGREMRVRYSVDMNPGTRRNPEVLNSTPKKILMYESQHKVYVGNLPWFTQPDGLRNHFSKFGTIVSTRVLHDRKTGRNRVFAFLSFTSGEERDAALSFNGTVNNMKVAESSSEKVSRRVSRKPTVLLLLQRHLLDTNNV

SEQ ID NO: 6731 - protein, 340 aa, SYNECHOCOCCUS SP. WH 8102
MRIGINGFGRIGRLVFRALWGRPGIELVHVNDPAGDAATAAHLLEFDSVHGRWDRGISSDADGFSVEGSPLTWSSEKDPTAVPWTARGVEMVLEASGKIKTPETLSPYFEQVGLKRVVVACPVKGDVAGEEALNIVYGINHDLYEPDRHKLVTAASCTTNCLAPVVKVVHESFGIEHGMITTIHDITNTQVPIDAFKSDLRRARSGLTSLIPTTTGSAKAIAMIFPELKGKLNGHAVRVPLLNGSLTDAVFELKQSVTVEQVNDAFKAASEGALKGILGYEERPLVSCDYTNDNRSSIIDALSTMVVDDNQLKVFAWYDNEWGYSCRMADLTCHVVGLDA

SEQ ID NO: 6732 - protein, 759 aa, Escherichia coli O157:H7 EDL933
  unsure (1)..(759): unsure at all Xaa locations
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNXLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 6733 - protein, 297 aa, Escherichia coli
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFLKNIEQLLAK

SEQ ID NO: 6734 - protein, 484 aa, Arabidopsis thaliana
MSLLLFIERVYMSIVVVFVKLLRRTPEKVHKWEPINDDDLELANTNYPMVLIQIPMYNEKEVCQLSIGAACRLSWPLDRMIVQVLDDSTDPASKELVNAECDKWARKGINIMSEIRDNRIGYKAGALKAGMMHNYVKQCEFVAIFDADFQPDPDFLERTIPFLIHNHEISLVQCRWKFVNANECLMTRMQEMSLNYHFVAEQESGSSIHAFFGFNGTAGVWRIAALNEAGGWKDRTTVEDMDLAVRACLHGWKFVYVHDVEVKNELPSTFKAYRFQQHRWSCGPANLWRKMTMEILQNKKVSAWKKLYLIYNFFFIRKIVVHIFTFVFYCLILPTTVLFPELQVPKWATVYFPTTITILNAIATPRSLHLLVFWILFENVMSMHRTKATFIGLLEAGRVNEWVVTEKLGDTLKSKLIGKATTKLYTRFGQRLNWRELVVGLYIFFCGCYDFAYGGSYFYVYLFLQSCAFFVAGVGYIGTFVPTV

SEQ ID NO: 6735 - protein, 356 aa, Ocimum basilicum
MALQNMDISLSTEQLLQAQAHVWNHMYAFANSMSLKCAIQLGIPDILHKHDHPMTLSQLLKAIPINKEKSQSFQRLMRALVNSNFFIEENSNNQEVCYWLTPASRLLLKGAPLTVAPLVQVVLDPTFTNPWHYMSEWFKHENHATQFEAANGCTFWEKLANKPSMGRFFDEAMSCDSRLVAHVLTKDYKHVIDGIRTLVDVGGGNGTMAKAIVEAVPTMKCTVLDLPHVVAGLESTDKLSYIGGDMFQSIPSADAILLKFIIHDWDDEEGLKILKRCKDAVGIGGKVIIIDVVVGVNHDVDEVLEDQLHFDMAMMSYFNAKERTMNEWEKLISAAGFTSYKLTPAFGVRSLIEAYP

SEQ ID NO: 6736 - protein, 83 aa, Glycine max
MMTMLTRFTFCHFCLEATTVTATAAKKLFGLKSNVFRSNEIGENEKSWFMMLRSRYLIGQTHHVEWSKIQTPTDEWVVTYDTM

SEQ ID NO: 6737 - protein, 133 aa, Triticum aestivum
MMLLFPEGTTTNGDYLLPFKTGAFLARAPVQPVILRYPYKRFSPAWDSMDGARHVFLLLCQFVNHLEVVHLPVYYPSEQEKDDPKLYADNVRKLMAVEGNLILSDLGLAEKRVYHAALNGNNSLPRALHKKDD

SEQ ID NO: 6738 - protein, 677 aa, Klebsiella pneumoniae
MKLAALATLFVPGMAFAAWTTTDFPAFTEEGTGRFISQKVVEKGTRPLQLNFDQQCWQPSGGIKLNQMLSMEPCRGTPPQWRIFRQGLYTLEVDTRSGTPTMMISLEEKETSAAAPQIRQCPKWDGKPLTIDVSKTFAEGSKVRDFYSGNVATVSGGKITLQPAFGSNGLLLLERAETAAPAPFDWHNATVYFVLTDRFVNGNPANDNSYGRHKDGMQEIGTFHGGDLQGLTSKLDYLQQMGVNALWISSPLEQIHGWVGGGTKGDFPHYAYHGYYTQDWSKLDANMGTEADLRRLVDEAHKRGIRILFDVVMNHAGYATLADMQEFQFGSLYLQGDELKKTLGERWTDWKPGAGQTWHSFNDYINFSDKAGWEKWWGKKWIRIDIGDYDNPGYDDLTMSLAFLPDLKTESKEISGLPNFYSHKPDTAAKAIPGYTPRDYLTHWLSQWVRDYGIDGFRVDTAKHVEMDAWQQLKTQATAALAEWKKANPDKALDAAPFWMTGEAWGHGVMQSDYYRHGFDAMINFDYQDQAAKAATCMANIDLTWQQMADKLQSFNVLSYLSSHDTRLFREGGATAAELLLLAPGAVQIFYGDESSRPFGPTGSDPLQGTRSEMNWQDVNGKAARSVTHWQKIGQFRARHPAIGMGKQTTLSMSRGYGFVRESGEDKVMVIWAGQQQ

SEQ ID NO: 6739 - protein, 463 aa, Bacillus anthracis str. A2012
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 6740 - protein, 249 aa, Oryza sativa (japonica cultivar-group); identical to SEQ ID NO: 4959

SEQ ID NO: 6741 - protein, 328 aa, Leptospira interrogans serovar lai str. 56601
MKHYDVFGVGNALVDILVPTENVFIKRLGFEKGIMTLVDSEKQAEVLTALEGSKKELRSGGSAANTMIALANSGGTGTYTGKVSKDTYGEFYKKDMENAGILFEVAPEDKGHTGTCVVLTTPDAERTMLTHLGISITLQKSDVDLEKLKSSSISYIEGYLWDGQGTKEASLLTMEESKKNGVKVAYTYSDPFCVNRSREDFIRLTKEYFDIVFCNTEEAKALSQREDKLEALKFISGLSALVFMTDSANGAYFAENGKISHVDGFPVKPIDTTGAGDCFAAGVLYGITHGFSLEKSTRWGNYVASRIVQEVGPRLGIKLMGRQDEILK

SEQ ID NO: 6742 - protein, 583 aa, Yarrowia lipolytica
MIPFTKINLELLLLPLLIIPITLFLLVLNVQVNTVHRRYKEYRLKLARCPQQSTGLFGWWLIYAVVRCNRDRFYSAKVVDYFTKLRTFIVSLGGELVIYTSESENIKALLATQFSDYDLGKTRHALLFTLMGDGIFTLDGQGWAHSRALLRPQFSKETVSPLSSLETSLQQLMAIVKRRVALKGEVDIQELFFMLTMDTATNLLYGESVDSLGDCLKETKKETHVMTDGKRNLLQSRDHHSNVPNEWEPIYGTYEKKGLGIGSENSLQSGVSPRDSPVFEVSVSEDIRKAYPAALTTALEFSAMRSKLQRFYWIWGDVLYRQKFHSAVNTVHAFSNHFVNQALKLTPQELQMKSAEKYTFLYELAQRTRDPVAIRDQLINILIAGRDTTAALLSFVFLCLVANPEKLAKLREGIMTDFGTSTDSITFESLKRCVYLRYVINEALRLCPPVPINMRQANKDTTLPTGGGKNHDEPIFVAKNQIVTYSVLFMHHNQNIWGPDASEFRPERWGEPACPKGWEYLPFNGGPRICLGQQYALTEAAYVIVRLVQEFTEIEWRDRKGLPVLFKTHITMSLGEGLRVHMK

SEQ ID NO: 6743 - protein, 406 aa, Oryza sativa (japonica cultivar-group)
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 6744 - protein, 427 aa, Oryza sativa
  unsure (1)..(427): unsure at all Xaa locations
MLPQQQQQQKQQAAALMPPSIVXKPPTSTLHHQHHPFLAAAPPQQQIEPILTGNLPPGFDTSTCRSVYVGNVHVQVTEALLREVFQSTGLVEGCKLIRKEKSSYGFVDYYDRRSAALSILTLNGKQIFGQLIRVNWAYASGQREDTTDHFNIFVGDLSPEVTDSALFAFFSGYSSCSDARVMWDQKTGRSRGYGFVSFRNQQDAQSAINDLNGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 6745 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 6746 - protein, 191 aa, Glycine max
  unsure (1)..(191): unsure at all Xaa locations
FLRELRHQLYFHLDYLEMVGILELPILVILDEAYIEXFSAIESRMSXGVKKHDNLIVLRTFSKRAGLAGLRVGYGAFPLSIIEYLWRAKQPVXMVSXAAEXSACXAALQNPTYXEDVKNXLLXKRRGRLYDLFEEVPFXPAFXSHFYFILCEVXPGRDARNLGRTYTNGVDDPHYXQKELKGYVRVTCGEA

SEQ ID NO: 6747 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIRKENNFKQPGERYRSWDSDRQERFVKRFVEALSEPRVTHEIRSIWISYWSQADKSLGQKLATRLNVRPNF

SEQ ID NO: 6748 - protein, 459 aa, Triticum aestivum
  unsure (1)..(459): unsure at all Xaa locations
MAFSSLSTPSSSSPSSSFTLPTKPSPGAGSLSFSRASTGRFRMAAVRAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVSNGAKQCITQAVLAVCSPGDEVLIPAPFWVSYPEMARLAGATPVILPTSISDNFLLKPESLASVITEKSRLLILCSPSNPTGSVYPKELLEEIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVATMVKAFQERRDYLVSSFRELPGVKISEPQGAFYLFIDFSSYYGSEVEGFGTIKDSETLCMFLLEKAQVALVPGDAFGDDKXVRISYAAALSTLQSAMEKIKDAMALLKAPAAVQ

SEQ ID NO: 6749 - protein, 253 aa, Azotobacter vinelandii
MNMKRKQVIGNWKMNGDLAANRRLLDELLPSLAALDGVELAVCPPFPYLAQVAALLEGSGVALGAQNLNVAAKGAFTGEVSAGMLGELGCRYVLVGHSERRSLYGECDETVAEKFAVALRAGLVPVLCVGETLAQRRQGRTEALVSAQLQAVLRRSGIEGLAAGVIAYEPVWAIGNGETASPEQAQAVHRHIRDLLAQHDPARGVATPILYGGSVKADNAAALFAQPDIDGGLIGGASLEAAAFAAICQAAAR

SEQ ID NO: 6750 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 6751 - protein, 354 aa, Xanthobacter flavus
MALVSMRQLLDHAADDSYGLPAFNVNNMEQVKAIMDAARATSSPVILQGSAGARKYAGEPFLRHLIAAAVEAYPEIPVVMHQDHGASPAVCMGAIKSGFSSVMMDGSLKEDGKTPADYDYNVSVTAKVVELAHAVGVSVEGELGCLGSLETGKGEAEDGHGAEEALDHSKLLTDPDEAAQFVKATQCDALAIAIGTSHGAYKFTRKPTGDILAIDRIKAIHQRIPTTHLVMHGSSSVPQELLEEIRTYGGDIKETYGVPVEEIQEGIRYGVRKVNIDTDIRLAMTAAIRRVGAKNKSEFDPRKFMAAAMEEAKKVCIARFEAFGSAGKAEKIRAIELDEMAKRYASGELAQVVH

SEQ ID NO: 6752 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 6753 - protein, 488 aa, Vaucheria litorea
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGVNRAVAASGEVKGSYLNTTAGTMEEMYERAEYAKSIGSIIVMIDLVIGYTAIQSMSIWARKADMILHLHRAGNSTYARQKNHGINFRVICKWMRMAGVDHIHAGTVVGKLEGDPLMVKGFYNTLLLTKLEINLSQGVFFEMDWAALRKTVPVASGGIHCGQLHQLLYYLGDDVVLQFGGGPIGHPDGIQAGATANRVALEAMVLARNEGRDYLNEGPQILRDAAKTCGPLKTALDLWKDITFDYTSTDTPDFVEIATKSK

SEQ ID NO: 6754 - protein, 292 aa, Vigna angularis
MGSSLWTCLILLSLASASFAANPRTPIDVPFGRNYVPTWAFDHIKYLNGGSEIQLHLDKYTGTGFQSKGSYLFGHFSMYIKLVPGDSAGTVTAFYLSSTNAEHDEIDFEFLGNRTGQPYILQTNVFTGGKGDREQRIYLWFDPTTQYHRYSVLWNMYQIVFYVDDYPIRVFKNSNDLGVKFPFNQPMKIYNSLWNADDWATRGGLEKTDWSKAPFIASYKGFHIDGCEASVNAKFCDTQGKRWWDQPEFRDLDAAQWQKLAWVRNKYTIYNYCTDRKRYSQVPPECTRDRDI

SEQ ID NO: 6755 - protein, 307 aa, Glycine max
IRLERLELLGICGLPDTIFRNAVEMALADSECYGLENPNARLSCFVNKAFANIGSDMAKLVPGRVSTEVDARLAYDTHAIIRKVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESVASPDEKYSFVRRLSPQSAAKYTFSDEELVRWDEDSLSKAMGPAAVQLLAAGLDGHADQAKRVEELFGKIWPPPNV

SEQ ID NO: 6756 - protein, 437 aa, Stenogramme interrupta
VDPIEASAAVAGESSTATWTVVWTDLLTACDLYRAKAYKVDSVPNTDDQYFAYVAYDIDLFEEGSIANLTASIIGNVFGFKAVSSLRLEDMRLPVAYLKTFQGPATGIVSERERMDKFGRPFLGATVKPKLGLSGKNYGRVVYEGLKGGLDFLKDDENINSQPFMRWKERYLYAMEGVNRSIAASGETKGHYLNVTAATMEDMYERAEFAKQLGSIIIMVDLVIGYSAIQTMAIWARKNDLILHLHRAGNSTYSRQKIHGMNFRVICKWMRMAGVDHIHAGTVVGKLEGDPLMIRGFYNTLLLPYLEVHLPQGIFFEQDWASLRKVTPVASGGIHCGQMHQLLDYLGVDVVLQFGGGTIGHPDGIQAGATANRVALETMVMARNEGRDYVAEGPQILQDAAKTCGPLQTALDLWKDITFNYTSTDTADFVETPTANV

SEQ ID NO: 6757 - protein, 297 aa, Leuconostoc mesenteroides subsp. mesenteroides ATCC 8293
MTRITDIYKKKSAPVLSFEIFPPKTEDGLHALYKTLQEVNPKETGVDYISVTYGAGGGSNHKRTKEIAEYIERNCGITALHNLTGINQTPSSLKGNLEKISVAGVENIFALRGDTPTKDYVNEYYPFAKDLIKEIKKDGRFDIGAAIYPEGHVDNPTTGISVTGVKEKVISGTEFLISQLFFDNGVFYNMQEALKENYIKVPVSAGILPIISRAQVERITYMIGSSLPARLAKIVHKYEDQPEALQQAGIEYALEQIHDLLDHGVDGIHLYAMNQPNVLKIMLPEINRHIQSKILTL

SEQ ID NO: 6758 - protein, 372 aa, Oryza sativa (japonica cultivar-group)
MVVHVVYRRRESSWRGGETSARLHQGAAAMSNPAGGKHLVRLAGSSSLRGGAALSPAVSISSGSRPATRAGARALRAASPPPACSIASVGCWESRALRLDGDEDWEVVVAQGDDAVGADSGAFDAVQEAADEHAEAFGAPPTDQEVRAAVASIQEVFENHPGLDSDAPAQALALSPISGLPPSGMFVNYFSEGSTPSDIKIEDSTPSDVKIDQLASLEHSTPDTASEECIEPAMLVLNSTALLTREHRNVLDAFHLLQVDSSVQKMVMALSTDKSVWDAVMKNEVVQEFRKSFQDAKEADPNGSSSASPGVMKWVMETTQAKIKEFLESILKLVNMLFQAQSEDYDLYDDTVRMSFMLAVFVFIVVTVARIK

SEQ ID NO: 6759 - protein, 233 aa, Triticum aestivum; identical to SEQ ID NO: 5113

SEQ ID NO: 6760 - protein, 371 aa, Triticum aestivum
  unsure (1)..(371): unsure at all Xaa locations
MARRSAPLLRRVLSPAPPSPLAGAVSRRTVTYMPRPGDGAPRTVTLIPGDGIGPLVTGAVRQVMEAMHAPVCFETYEVHGDMPSVPPEVIESIRRNKVCLKGGLATPVGGGVSSLNLQLRKELDLYASLVNCFKLPGLPTRHDNVDIAVIRENTEGEYSGLEHEVVPGVVESLKVMTKFCSERIAKYAFEYAYLNNRKKVTAVHKANIMKLADGLFLESCREVATKYPGIQYSEIIVDNXCMQLVAKPEQFDVMVTPNLYGNLVSNVAAGIAGGTGVMPGGNVGQDHAIFEQGASAGNVGNDKIVQQKKANPVALFLSSAMMLRHLQFPSFADRLESAVKSVIAEGKYRTRDLGGTSTTQEVTDAVIAKLD

SEQ ID NO: 6761 - protein, 454 aa, Hypnea pannosa
GYWDPEYVVKETDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERFLYAMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 6762 - protein, 648 aa, Geobacter metallireducens
MAGTGAGLRLCRRVLSDIRGRLYTLARIPMLGTGSRALEDARMVQEHTESFWGGIIKSMGLVFGDIGTSPIYTLTVIMTLTKPDAEHVLGILSLIVWTLIILVSVEYAWLAMSLGRKGEGGTIVLKEILVRLLKSGRQVAFVGFLAFMGVSLLLGDGIITPAISILSAVEGMRLIPGWENLAQGVLIFIAAVIALILFIFQFKGTDKVAGAFGPIMVIWFGALTLSGIVSIAGTPEVVSAVSPHHAVTFLMHNGLAGFFILSEVILCATGGEALYADMGHLGRKPIIRAWYFVFSALVINYLGQGAFILRNPNETNILFSMVKSQAPILYIPFLCLTIMATIIASQALISGVFSIVYQGITTRILPLMKVDYTSTHLKSQIYIGSVNWSLLVAVIFIMLIFKKSENLAAAYGLAVTGTMFITGIMMTMIFSHTTKKWKVPIALAVTLIDLVYLTANFHKLPHGGYWSLILASIPLAIMIIWTQGQKALYRALRPLDLDTFLLSFGQIYAKGHNIPGTGLFFVRETAVVPPYVIHCIIRSNIIYERNVFVSLNRSDEPFGVKANLTKGIGPGLDSFEILAGYMELVDIERLLKKKGIEEKVIFYGIEDIATNNPFWRVFSTIKRQTANFVQFNKLPVSKLQGVVTRVEM

SEQ ID NO: 6763 - protein, 484 aa, Synechococcus sp. PCC 7002
MTFSFDSWFRGLSPRLSYPFRRQGRLLLLACMLPLLWQGVAIAQGSLGEIPPAVQVTLDTLWVVFAAMLVFFMNAGFAMLESGFCRAKNTVNILAKNLIVFALSSLAFWAIGFALMFGDGNAVLGWNGFFLTGADNSPLTGSAYSGIFSSLSWAGIPLYTKFFFQLAFAGTAATIVSGAVAERIKFASFVIFSLFLVGFSYGITGHWVWGGGWLATLGFYDFAGSTVVHSVGGWAALMGVILLGPRLEKFAGDRINAIPGHNMSTATLGGLILWLGWFGFNPGSTMAADPDAISHIIVTTNMAAAAGAIAATITSWIQFGKPDLSMIINGVLAGLVGITAACAYVNVPSAIVIGAIAGVIVVFSVLTFEGLRFDDPVGALSVHLVCGIWGTLAVGLFSVGGDIYPWYAADAGPSAGLLFGGGVAQLLSQFIGVVVVGMFTAGFSFAIWLVLELSMGLRVSKEEELEGLDIGEHGMEAYHRFFRE

SEQ ID NO: 6764 - protein, 475 aa, Lactobacillus sakei
MTEEKPAKKIGLLALIALVISSSIGSGVFGLTSDLASASAPGPVLIAWVIVGFGILMLALSLNNLLMKEPELEGIFSYAEKGFGPFAGFISGWGYWLSAWLGNVTFATILMSALGYFFPIFKSRQNLPSILVASVLSWSLTYFVNRGVEGAAAINTLVTICKLIPLFVFIIFGIVLFKGHLFTQAFWNNMSSSFVAGDVMSQIKNCMMVMMWVFVGIEGASMLSARAEKKSDAGKATILGLVSLLAIYILASVLPYGYLTQDQLASIKQPAMLYIFEQMVGTWGGYFIGVGLIISILGAWLSWTMLPAETMLLMAKQNLLPAYFGRVNKKKAPTFALVVTAGLIQVFLFTLLFTTKAYNFAYSLCTASIIVCYMLVAAYQIKYSWAHLQEKGNRQQLLIGVLALLFEIAGILMAGVSYLLLCFIAYIPGIYFYGRARKNNGHQHFLSKGEWLITTIIVIGAIIGIWLVVSGKIVI

SEQ ID NO: 6765 - protein, 335 aa, Schizosaccharomyces pombe
MDIEKSDKWTYVKERKVGEGTYAVVFLGRQKETNRRVAIKKIKVGQFKDGIDISALREIKFLRESRHDNVIELVDVFSTKSNLNIILEFLDSDLEMLIKDKFIVFQPAHIKSWMVMLLRGLHHIHSRFILHRDLKPNNLLISSDGVLKLADFGLSRDFGTPSHMSHQVITRWYRPPELFMGCRSYGTGVDMWSVGCIFAELMLRTPYLPGESDLDQLNVIFRALGTPEPEVIKSMQQLPNYVEMKHIPPPNGGMEALFSAAGHEEIDLLKMMLDYNPYRRPTAQQALEHHYFSALPKPTHPSLLPRKGGEEGIKHVSSDLQRQNNFPMRANIKFV

SEQ ID NO: 6766 - protein, 229 aa, Pneumocystis carinii
MAPSSLSFPSSHILMSGAMYPGSRDEKGLEHGVSTSLNQTATSAFAGVSGIVPSLQNIVATVNLDCRLDLKTIALQRRNAEYNPKRFAAVIMRIREPKTTALIFASGKMVVTGAKSEDDSKLASRKYARIIQKLGFNAKFTDFKIQNIVGSCDVKFPIRLEGLAYSHGTFSSYEPELFPGLIYRMVKPKIVLLIFVSGKIVLTGAKVREEIYQAFEAIYPVLNEFRKSS

SEQ ID NO: 6767 - protein, 261 aa, Saccharomyces cerevisiae
AQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 6768 - protein, 187 aa, Cryptomeria japonica
ICTYFAQPLHQRDYTRWPEKPEGWREIVDKYSEVLMGLASKLLAIISEALGLEPEAVTKACVEMDQKVVINYYPKCPQPDMTLGLKRHTDPGTITLLLQDQVGGLQATKDDGLNWITVEPVQGAFVVNLGDHMHYLSNGKFKTADHQAVVNSNYSRLSIATFQNPSQGAIVYPLKLEEGEQSFMEEP

SEQ ID NO: 6769 - protein, 385 aa, Pyrocystis lunula
MSKPDHVLAEVRPFDGGKGSNHGASGEASNKKTSFTYNAERVLGSGSFGIVYQAQVVETGESVAIKKVFQDKRYKNRELQIMRELKHPNVVELKHAFYTSGDKPGESYLNVVMEYCSDTVYKMMKHYIKMKTPVPHIFVQLYSYQMNRACAYIHSVGICHRDIKPQNLLVDGTTHALKLCDFGSAKRLVKGEPNVAYICSRYYRAPELIFGATDYSTIIDIWSTACVTAELILAQPIFPGESGVDQLVEIIKVLGTPTREELMAMNPNYTEFKFPQIKPHPWHKVFLLQDHAGGRRLHLEAPRVRPEGAALGARVLCTPAVCDLRDRNTLISNAKGQALPSSIFAFSQEERALMDSDLRRKLIPDWVATRDKEQGPGAHDVGGSL

SEQ ID NO: 6770 - protein, 137 aa, Zea mays
  unsure (1)..(137): unsure at all Xaa locations
MINPKKLAQLARKWQRVKIATKDDDRCCTISPIAGRGHCTVYTVDGSRFEVPLAYLRSVVFSELLRMAAEEFGFTGNGRITLPCDAAVVXYMICLLQRNASEEVEKAFLSSVVMPCQQSSYPTPPVVLHQQFAVCSS

SEQ ID NO: 6771 - protein, 203 aa, Magnetospirillum magnetotacticum
MTDNRPILTTRQGHPVRDNQSTRTVGERGPATLENYQFIEKITHFDRERIPERVVHARGAGAHGWFEAYGKIGDEPASKYTRARVLNETGVKTPMFVRFSTVAGAKESPETERDPRGFAVKFKTVEGNWDLVGNNLKVFFIRDAIKFPDMIHAFKPDPVTNRQEAWRFFDFVAQHPESIHMVTWLKSPWGIPANYREMEGYGR

SEQ ID NO: 6772 - protein, 234 aa, Glycine max
  unsure (1)..(234): unsure at all Xaa locations
MGVTPKIAPSMLSSDFANLASEAQRMLHFGADWLFRAEWVXMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQQTLIQ

SEQ ID NO: 6773 - protein, 76 aa, Prunus persica
WGPLGWTVPSEIFPLETRSAGQSITVAVNLLFTFIIAQSFLALLCALKFGIFLFFAGWITVMTVFVYVFLPGTKGV

SEQ ID NO: 6774 - protein, 79 aa, Triticum aestivum
  unsure (1)..(79): unsure at all Xaa locations
MLSQILSSEARERLSRIALVKPDKARGVEDVLLRXAQLVEYXKVSEERLISLLEQINSHTSKQTKVTIQRRRNVLDDDD

SEQ ID NO: 6775 - protein, 390 aa, Methanosarcina barkeri
MHRRFGGVLEVASKVSLQTIHDLSVAYTPGVAEPCRKIIKDPELVYLYTMKRNTIAVVTDGSAVLGLGNIGPYAALPVMEGKAIIFKEFAGIDAFPICLDTQETEEVIKAVKHLAPAFGGINLEDISAPRCFEIEGRLREELDVPVMHDDQHGTAIVVFAGLLNALKIVNKKLNELHIVISGMGAAGVAIFRFLVRAGANPARILVCDSKGLVYEGRKNGMNPVKEEVARLTNPEKLKGGLENAFPDADLFIGVSVGGIVNEEMVRSMAKDAIVMAMANPLPEIMPDAAKRAGARVVATGRSDFPNQLNNCLSFPGVFKGALSTCARKITPEMEMAASHALAEVVTLNELSEDRIIPDPLDRRVVPAVAKAVASASLESCVARKSHEDMA

SEQ ID NO: 6776 - protein, 208 aa, Glycine max
MNRDRDYELENGLALFGSDEELATQIPTQAQSLVEGSGSIRVAEFKPVPDVDYLQELLAIQQQGPRAIGFFGTRNMGFMHQELIEILSYAMVITKNHIYTSGASGTNAAVIRGALRAEKPELLTVILPQSLRKQPPESQELLSKVKNVIEKPHNDHLPLIEASRLCNMDIISHVQQVICFAFHDSRLLMETCQEAKNLRKIVTLFYLD

SEQ ID NO: 6777 - protein, 324 aa, Bacillus cereus
CIGCHACSVTWKKTWTNRPGAEYMYFNNVETKPGIGYPKQWENQEKYKGGWELKNGEIQLKSGSKMKRLMNIFHNPDQPTIDDYFEPWNYDYETLTNSPQRKHQPVARPKSAITGEFIDKIEWGPNWEDDLAGGHITGLQDPNVKKMEEGIKTDFENVFMMYLPRICEHCMNPSCVSSCPSGAMYKREEDGIVLVDQNACRAWRFCVSSCPYKRVYLNLQTNKAEKCTMCFPRIEAGMPTICSETCVGRIRYIGVMLYDADKVKEAASAPNEKDLYESQLTVFLDPNDPEVAAEAKKQGIPEEWIKAAQESPIYKMIIDCASAA

SEQ ID NO: 6778 - protein, 484 aa, Nicotiana glutinosa
MVFISSNNQKQQLLSKIATNDGHGENSAYFDGWKAYENDPFHLINNPNGVIQMGLAENQLCFDLIQEWVVNNPKASICTIEGAENFKDIAIFQDYHGLPEFRQAVARFMENVRGDRVTFDPNRIVMSGGATGAHETLAFCLANPGDAFLVPTPYYPGFDRDLRWRTGVQLFPVVCDSSNDFKVTKKALETAYEKAQESNINIKGLLINNPSNPLGTLLDSDTLRDIVKFINSKNIHLICDEIYAATVFDQPKFISVSEIVEEHVGCNKDLIHIVYSLSKDMGFPGFRVGIVYSYNDTVVNIARKMSSFGLVSTQTQHLIASMLSDEIFVEKFIAESSERLGKRHGMFTKGLAQVGISTLKSNAGLFFWMDLRRLLKEPTFDSELELWRIIINEVKLNVSPGCSFHCSEPGWFRVCFANMDDETMRIALRRIRNFVLQTKGLNNKAAVKKQCSRSKLQISLSFRRMDDFMNSPVHSPMNSPLVRT

SEQ ID NO: 6779 - protein, 244 aa, Zea mays subsp. parviglumis
SIRNNPVQNKLMNGEDPINNNHAQTAGGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISARTPSSDAPVPVPPPIRDSIVGYFSAPAADDDASVGNGFLRLQAHQEPASMVVGGTLSATEMNRVAAATHCAGAMELIQTAMG

SEQ ID NO: 6780 - protein, 526 aa, Triticum aestivum
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGGELMQSTQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVEKVEKFVGDATSKGANIMLGGKRHSLGMSFYEPTVVGNVSNDMLLFREEVFGPVAPLIPFKTEEEAIHLANDTNAGLAAYMFTKSIARSWRVSEALEYGLVGVNEGLISTEVAPFGGVKQSGLGREGSKYGMDDYLEIKYVCMGNLG

SEQ ID NO: 6781 - protein, 372 aa, Oryza sativa
  unsure (1)..(372): unsure at all Xaa locations
PTTPIDDTKAGVKGPPSTPAYTTVPYYLYRHHPDPLPVAAPSEAASAIPLIDLAKADVDRGRVGTXEVRAAAETVGFFQVVNHGVAGELMEEMLAAVRRFHEEPLEAKVPYYTRDVASKVWFNSNFGLFRNGFRSPEANWRDTMFVEMFPEAPSPEEIPPPCRGVLEVYAAAVRRLGERLFELLSEALGLPVGYLGRDAGCMDGLSLSVAAHYYPACPEPEATMGATKHSDPSFLTVLLQDTSGGLQALLDQPRRRWVDVPPVAGALVVNVGDFLQLVSNDRLRSVEHRVLPTGAAGPARVSVACFFRVEYASTRPYVPVVVGGGGARAAAVYRGTTAGEFLAHFNGKGLDGRSALDHFRIPAAASSPPPPL

SEQ ID NO: 6782 - protein, 562 aa, Shigella flexneri 2a str. 2457T
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPSPVWIDIPKDVQTAVFEIEAQPAVAEKAVAPAFSEESIRDAATMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPRVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQAALQEIINRPGPALIHVRIDAEEKVYPMVPPGAANTEMVGE

SEQ ID NO: 6783 - protein, 165 aa, Glycine max
MAEQALEGSQPVDLTKHPSGIVPTLQNIVSTVSLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKCLNTIKWER

SEQ ID NO: 6784 - protein, 388 aa, Synechocystis sp. WH 8501
MKAMILAAGKGTRVRPITHTIPKPLIPILQKPVMEFLLELLRKHGFDEIMVNVSHLAEEIEGYFRDGQRFGVQIGYSFEGKIVDGDLVGEALGSAGGLRRIQDFNPFFDDTFIVLCGDALIDLDLTAAVKYHRDKGAIATIITKSVPKESVSSYGVVVSDEEGRIKTFQEKPSVEEALSTNINTGIYIFEPEIMNYIPPNQKYDIGGELFPMLVEKGAPFYAVNMDFEWVDIGKVPDYWHAVRGVLSREIKNVQIPGIEVKPGIYTGLNVSVNWDKVNIQGPVYIGAMTHIEDGATIIGPSMIGPNCWVCSGATVDNSVIFEYSRLGPGVRLLDKLVFGRYCVDKTGAAIDVQAAALDWLITDSRQTFPDDTQIPQQAIAELLNQDNG

SEQ ID NO: 6785 - protein, 248 aa, Oryza sativa
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 6786 - protein, 323 aa, Oceanobacillus iheyensis HTE831
MTKKILLLATGGTIASEKKPNSDRLESGVLTGEELLKQCDIPSGIEVEVHSIFQKASIHLTFQDLLVLKSKIDELLLNSSFDGIVITQGTDTLEESSYFMNLITDYHIPIVFTGSQRSPLEVGTDSFINIKNAVLTACSEELNEVGVTVVFNERIFHSRYVRKEHASNIQGFNAFGYGYLGIIDNNQVRVFQKPTYKDYYKLQKKLPEVDIIKVYMNTDGKYIKAARDNQVDGIVIEGVGRGQVSPTMMQEIKQCIEEGIAVVITTSAVEGEVYPTYDYQGSTYDLLQNGVILGKDYDSKKARIKLMVGLASEIPLQTLFHPF

SEQ ID NO: 6787 - protein, 212 aa, Triticum monococcum
MSMSCGSCGANNCPRLMVSPIHHHHHHHQEHQLCEYQFFAHGNHHHHHGSAADYPVPPPPDNFDHRRTWTRPFHETAAAGNSSRLTLEVGAGGQHMAHLVQPPARAHIVPFHGGAFTNTISNEAIMTIDTEMMVGPAHYPTMQERAAKVMRYREKRKRRRYDKQIRYESRKAYAELRPRVNGRFVKVPEAMASPSSPASPYDPSKLHLGWFR

SEQ ID NO: 6788 - protein, 432 aa, Daucus carota
MASKAVITQRHKEAEGKQKNVQAERRNRRVLGDIGNVVKAVDAGKPKNPIKTNRPMTRSLCAQLVAKGLPVVGGKDPKDIQLIDGVVGRKDASVLEAAAVKKKDTDQRTTVTLSCEEEIKPKSSGRKSRPDYSEKTEKAFTSILSARSKAACGLINKPQNEIIANIDASDVDDELAAVEYVDDIYKYYKLTEGDGQVHDYMPSQTDINSKMRSILIDWLVEVHRKFELMPESLYLTINIVDRYLSMKIVPRRELQLVGVGSMLIACKYEEIWAPEVNDFIAISDNAYNREQVLLMEKSILAKLEWYLTVPTPYVFLVRYIKSSVPSDPEMENMTFFLAELGLTHYTTVMTYCPSVIAASAVYAARCTLKKSPFWTETLKHYTGYSEDQLRDCAKLLVSYHAALSESKLKAVYKKFARPEKGVVALVPPLKLI

SEQ ID NO: 6789 - protein, 480 aa, Triticum aestivum
MPASPRPSALPPRGWATDCARDWRVTAHRRRWGQHGQRLVSDNHLRPPPSASHGASPPFSAPSPRISASNSPPQSPVPGSWRRGEAMGSFAKLAKRCVETEAPVMVKIQELLRGATDVMSLAQGIVYWQPPEAALNKVKEIVWEPATSKYGADDGLPELREALLEKLRRENKLTKSSVMVTAGANQAFVNLVLTLCDAGDSVVMFAPYYFNSFMSFQMTGVTDILVGASNPKTLHPDVDWLEKVLKENNPIPKLVTVVNPGNPSGAFIPKPMLQRISDLCRNAGAWLVVDNTYEYFMYDKMEHYCLEDDHIVNLFSFSKAYGMMGWRVGYIAYPSEADGFHAQLLKVQDNIPICASIIGQRLALYSLEAGPEWIRERVNDLVKNRELLVEAMSPLGEDAVKGGEGAIYLWAKLPDNCSDDFEVVRWLATKHGVAVIPGSASGGPGYIRVSFGGLKEEDTRLAGERLRRGLQELVTDGMVQ

SEQ ID NO: 6790 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXXXXAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 6791 - protein, 566 aa, Oryza sativa (japonica cultivar-group)
MCESSPSLMQPSPSSPRAPPPTAAQASGYKHFCRVCNKGFTCGSALGGHMRAHGVGDGDGLGADDDDDDDDDSLGDEAVRRARGGADDPWNAGGPSSSGAATHVYELRTNPNRVTRSRQVCKNCGKEFTSWEHFLEHGKCSSGEDDDDEDDVDHSLQPWSPSPEADGEEDSAPAAGWLKGKRSRRCKGTGVDLSPTPSACAAGEEEDLANCLVMLSSSKVDQAGVTEAEQRSSSSASKEHKRLITFMEPTTYVLDTVMALPPPAPAPQYVSTVPRGMFECKACKKVFSSHQALGGHRASHKKVKGCFAAKLESNAAEVAEPSHHAEVADRSEDNPAKATSDARRNVHASIDGDGNAGTSDAAAELSMAIVPIEPPVAALAAAPLKKKGKMHECSVCHRLVTSGQALGGHKRCHWLTSSSADHTASVPPLADDLVPLSFRPMLDAPEPALDLSIAANPPLLASAATVRPKVGGSSFHLDAPPPVYIPSSPAIPSQRNKATATTGSQNANDAVGLSTAAAEDEADSTTVKRARLSDLKDVSMAGETTPWLQVGIGSSSRGGADDNDKE

SEQ ID NO: 6792 - protein, 93 aa, Malus x domestica
WTAEEDEKLMDYIQKHGYGNWRTLPKNAGLQRCGKSCRLRWTNYLRPDIKRGRFSFEEEETIIQLHSILGNKWSAIAARLPGRTDNEIKNHWK

SEQ ID NO: 6793 - protein, 122 aa, Oryza sativa (japonica cultivar-group)
MAIACALSVAAPSLTGKTNSNPPPRRSFQQQWRERRRRGVAARFSGKSADVDAEADSGRIEDDSSYLWKLGLGSVGGAAAIKYGSILLPDITRPNIVVALLMVSIPVAVAVLLLLKVSSRDD

SEQ ID NO: 6794 - protein, 366 aa, Glycine max
MKGRFMFLSVLLCATFHVSFSIIDGLVANGNFELGPKPSALKGTVVVGGSHSIPEWEISGFVEYIKSGQKQGDMLLVVPEGAYAVRLGNEASIKQRIKVIKGMYYSITFMVARTCAQEERLNISVTPDWGVIPIQTLYTSSGWDPIAFGFKAESETVEMLIHNPGKEEDPACGPLVDSVALRTLYPPKATNQNILKNGGFEEGPYVFPNSSWGVIIPPNIEDDHSPLPGWMVESLKAVKYIDSDHFSVPQGKRAVELIAGKESAIAQVARTIPGKTYVLSFSVGDASNSCEGSMIVEAFAGKDTIKVPYESKGNGGFKRAALKFVAVTPRTRVMFLSTFYTMRSDDFSSLCGPVIDDVKLVSLRKP

SEQ ID NO: 6795 - protein, 475 aa, Aureococcus anophagefferens
  unsure (1)..(475): unsure at all Xaa locations
DRYESGVIPYAKMGYWDASYQVKATDLLALFRITPQPGVDPVEAAAAVAGESSTATWTVVWTDLLTACDVYRAKAFRVDPVPSAPDQFFAYIAYEGDLFEEGSLANMTASIIGNVFGFKAVKALRLEDMRIPHSYLKTFQGPATGVVVERERMDKFGRPLLGATVKPKLGLSGKNYGRVVFEGLKGGLDFLKDDENINSQPFMRWRERFIYCVEGINRAAAATGEVKGSYLNITAATMEEMIIRAEYAKELGSIIIMIDLVIGYTAIQTMAIWSRENDMLLHLHRAGNSTYARQKSHGINFRVICKWMRMAGVDHIHAGTVVGKLEGDPLMVQGFYDTLLKTKLAIDLPKGIFFDMDWAALRKCMPVASGGIHCGQMHQLLNYLGDDVILQFGGGTIGHPDGIQAGATANRVALEAMVLARNEGRNYVEEGPQILRDTAKMCGPLQTALDLWKDISFNYASTDTADFAEXPTAXV

SEQ ID NO: 6796 - protein, 218 aa, Eustoma grandiflorum
MGRGKIDIKRIENNTNRQVTFCKRRNGLLKKAYELSVLCDAEVALIIFSSRGRVYEYANNNIKSTIDRYRKATSDASTVFTTQEINAQFYQQESKKLRQQIQVLQNSNRHLMGEGLSSLNVKELKQLESRLERGISRTRSKKHEMILAEVEYLQKREIQLEQENACIRSKIAEQERLQELSMMPPGQDYNAMQAYLAQNFMQVNGLMEGPPVYSMLHK

SEQ ID NO: 6797 - protein, 313 aa, Zea mays
MAMIEYPSLEAATGKFSASNVLGVGGFGCVYKAVFDGGVAAAVKRLEAGGPECEKEFENELDLLGRIRHPNIVTLLGFCVHEGNHYIVYELMHKGSLDTQLHGASRGSALSWHVRMKIALDMARGLEYLHEHCSPPVIHRDLKSSNILLDSDFNAKISDFGLAVTSGNIDKGSMKLSGNLGYVAPEYLLDGKLTEKSDVYAFGVVLLELLMGRKPVEKMSQTQCQSIVTWAMPQLTDRTKLPNIVDPVIRDTMDPKHLYQVAAVAVLCVQPEPSYRPLITDVLHSLVPLVPVELGGTLRVAEPPSPNLKHSAC

SEQ ID NO: 6798 - protein, 430 aa, Prochlorococcus marinus subsp. pastoris str. CCMP1378
MKETIDFLIDTIEARQVLDSRGNPTVEAEVFLECGAIGRAIVPSGASTGAHEAHELRDGGTKYMGKGVLNAVNKIHETISPALCGLSALDQTSIDNLMIEIDGTPNKSSLGANSILAVSLANARAASNALDLPLYRYLGDPLSNLLPVPLMNVINGGAHAPNGLDCQEFMLVPHGVKTFSEALRIGTEIFHSLKSLLEKKGLSTAVGDEGGFAPELSSSEAAGDLLLEAIQKAGFIPGEQVSLALDVASTEFYKDGFYKYEGKSLTSSQMISYLSNLVSNYPIVSIEDGLAEDDWEGWSALNKEIGNKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGDQARFAGDLGLGPKNI

SEQ ID NO: 6799 - protein, 344 aa, Nitrobacter hamburgensis
IGCHTCSIACKNIWTDRKGTEYMYWNNVETKPGTGYPTRWEDQTKYRGGWVVDGTRQKSLRLRLQGKWGTLSNIFYNPYLPTLDDYFEPWTYDYQNLINAPLADEQPTARAISMVTGKYMDTIEAGPNWDDDLGGSQVYANNDPNFDGASDEEMRQINEINSTVFFYLPRICNHCLNPGCVAACPQGAIYKRGEDGVVLVSQERCRAWRMCVSGCPYKKTYFNWSTGKAEKCILCYPRLESGQPPACFHSCVGRIRYIGLVLYDADAIEETAKAPQDQLVMAQRNIIKDPFDPDIIAAARANGIPDSKIEAAQKSPVYQFVKKWGIALPLHPEFRTLPMLFYVP

SEQ ID NO: 6800 - protein, 225 aa, Enterococcus faecium
MLRKLFPKLGPGDIIIEGGNSYYKDSIRRAEEFQKNEIGYLDCGTSGGIEGARHQACLMIGGDKETFLSVEQLFKDVAIERGYLYAGASGSGHFLKMIHNGIEYGMMQAIGEGFQLVQKSEYAFDLEQVARVWNHGSVIRGWLMEIMEDQLNEHPNLSNYRGIVSASGEAKWTVETALEMAVPVPVIATSLFMRNLSQEEDSFSAKVVSALRNGFGGHEIVEKGE

SEQ ID NO: 6801 - protein, 306 aa, Vibrio cholerae
MKPTADILASIIEEVRPLTSKGIVADYIPALAKVPSDKLGIAVFTNQGEVITAGDAQEGFSIQSISKVLSLTLAMGLYQPDELWSRVGKEPSGQAFNSLIQLEMEQGIPRNPFINAGAIVVCDMLQSRLSAPRQRLLEFVRQLSGEPQIAYDKVVAASEMMHSDRNAAIAYLMRSFGNFHNEVIPVLHNYFHACALKMSCVELAKTFSYLANKGVSVVTGETVITPTQSKQTNALLATCGLYDGAGEFAYRVGMPGKSGVGGGIIAVVPGEMTIAVWSPALDQSGNSLAGTRALELLAQRIGRSIF

SEQ ID NO: 6802 - protein, 278 aa, Glycine max
MAATFFSHLSLLQSNNNPSLSHTPSRFPHSLTNRVKPSLGVVSVAKRVSGVVPKANLNALEANSGFPISAKKSNNNPIVVIDNYDSFTYNLCQYMGELGFHFEVYRNDELTVEELRRKNPRGVLISPGPGEPQDSGISLQTVLELGPTVPLFGVCMGLQCIGEAFGGKIVRSPHGVMHGKSSMVYYDEKGEDGLLAGLSNPFLAGRYHSLVIEKESFPHDELEATAWTEDGLIMAARHKKYKHLQGVQFHPESIITPEGKTIVRNFVKLIEKREAGGS

SEQ ID NO: 6803 - protein, 566 aa, Oryza sativa
  unsure (1)..(566): unsure at all Xaa locations
MDSARSWFQKFQPRDKSKSPAVAASHGKDPGKPPIDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAFIVKLYYSFQDEEYLYLIMEYLPGGDMMTLLMRKDTLTEDEARFYIAETVLAIESIHKHSYIHRDIKPDNLLLDRSGHLKLSDFGLCKPLDSSNFPNLNEPDYTSTKGTKPLPDSSSRLSSSALKRTQQEQLSHWQKNRRMLAYSTVGTPDYIAPEVLLKKGYGMECDWWSLGAIMYEMLVGYPPFYSEDPMSTCRCFILIFYSSXKIVNWRSHLKFPEEAKLSPEAKDLISKLLCNVEQRLGTKGAHEIKAHPWFRGLPWERLYQMKAAFIPEVNSELDTQNFEKFEETGAQIQSSSKSGPWRKMLPSKDANFVGYTYKNFEIVNDDEVAGIAELKKKSSKSKRPTIKTLFESMDEDEPVQGSFLNMLPHKEGQPSSHSTIPPEQYQPRHK

SEQ ID NO: 6804 - protein, 208 aa, Populus x canescens
LIAGGTESSAVTVEWAISEILRKPEVFEKATEELDRVIGRERWVEEKDMVNLPYIYAIAKEVMRLHPVAPMLVPRAAREDININGYDIKKGSRVLVNVWTIGRDPKVWDKPDEFFPERFIGNSIDVRGHDYELLPFGAGRRMCPGYPLGLKVIQATLSNLLHGFKWRLPDGQKKEDLNMDEIFGLSTPKKYPLVAVAEPRLPAHVYPK

SEQ ID NO: 6805 - protein, 431 aa, Lupinus luteus
MPSIAHSHVAAEPQHPKGENKQKNEGRNRRVLKDIGNLVVKQADPVANVPKRTTRNFGCQLLANAQAAAEKNKKPNTDVGNLAVVTKVEQTKKETEHEVIIISSDDEEEEKEKQVVKGGRKAREKVAGRGKNDKAFSAVLSARSKAACGLTHKPKDLVLVDDIDVADIANELEAVEYLDDIYKFYKLTEDDGRVHDYMPSQPDINIKMRSILFDWLIEVHRKFELMQETLYLTLNIVDRFLSMKAVPRRELQLVGISSMLIACKYEEIWAPEVHDFVCISDNAYVRENILIMEKTILSKLEWYLTVPTTYVFLVRYIKASTPYDKKIEDMIFFLAELSLMDYPLVISYCPSMIAASAVYAARCILGRVPYWTETLKHYTGYYEEQLRDCAKLMVNFHSVAPESKLRAVYKKFSSLERGAVALVAPTKNLLA

SEQ ID NO: 6806 - protein, 443 aa, Palmaria palmata
  unsure (1)..(443): unsure at all Xaa locations
VTPQPGVDPIEASAAIVGESSTATWTVVWTDLLTACDLYRAKCYKVDAVPNTSDQYFAYIAYDIDLFEEGSIANLTASIIGNVFGFKAVKALRLEDMRLPVAYLKTFQGPATGTVVERERMDKFGRPFLGATVKPKLGLSGKNYGRVVYEGLKGGLDFLKDDENINSQPFMRYSERYLYSMEGVNRAQAAAGEIKGHYLNVTAATMENMYERAEFAQQLGSVICMVDLVIGYSAIQSMAIWARKTDMILHLHRAGNSTYSRQKIHGMNFRVICKWMXXXXXXXXXXXXXVGKLEGDPVMIQGFYNTLLESHLEVNLPQGIFFEQDWASLRKCTPVASGGIHCGQMHQLLDYLGVDVVLQFGGGTIGHPDGIQAGATANRVALESMVIARNEGRDFVAEGPQILSDAAKTCXPLQTALDLWKDISFNYTSTDTADFVETPTANV

SEQ ID NO: 6807 - protein, 162 aa, Listeria monocytogenes EGD-e
MEQKTFIKVTCSILTISDTRNLDTDTSGQLIQSALETAGHEVISRVVVPDDVTLIKQKINELAANGSFCLITNGGTGIARRDVTYEALFATIQQEIPGFGEIFRMLSYEEVGSRAMVSRAFAGFSESGLLLFALPGSSNACQLAVQKLIIPELPHLIAERQK

SEQ ID NO: 6808 - protein, 499 aa, Triticum aestivum
MATTPRLASLLLLLALCAAAAGALRLPPDASFPGAQAERLIRALNLLPGRPRRGLGAGAEDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDPATGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYDRINKFIPPCEFAIKLCGTDGKASCMAAYMVCNSIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKESVPEEEPATTFYAA

SEQ ID NO: 6809 - protein, 542 aa, Oryza sativa
MRRSGNGGAAKKKKKRSASAASERRPRADGGMRIVVPLQGVVQGRGGLVLGSLIPCALFYFFQLYIKRNRASPPPPPGSPTAASAAAVSPIHRSLSRGLLAPRAALPAISARGASVRDDDSLYYAGLRRCAADPYHPVTNPSGIIQLGLAENYLSLDLVGRWMEEHAAEAASMAGGEDEDERELSIRGLAAYQPYDGILALKMALAGFMRQIMQGSVSFEPSQVVITSGATPAMEILSFCLADPRNAFLVPSPYYPGWDRDIKWRTGIELIPVPCRSTDNFNISITALEIAYNQAKKRGIKVRGVLISNPNNPTGSFVPKQTLHDLLEFAAEKNIHLISDEVFAGSTYGSGKFVSVAEVVDDLEDFDKGRVHIIYGLSKDLSLAGFRVGVIYSYNESIVTAAAKIARFSSVSTPTQRLLVAMLSDQKFISDYLKVNRERLRKMYHLFVDALDQVGIECYKSSGGFYCWADMSKFIRSYSEKGERKLWDRLLEEAKVNVTPGSSCHCIEPGWFRCCFTTLSEHDIPVLVQRLRTITDSHKPNH

SEQ ID NO: 6810 - protein, 110 aa, Oryza sativa
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 6811 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCRVQVEKALENVLK

SEQ ID NO: 6812 - protein, 503 aa, Halobacterium sp. NRC-1
MTYQHYINGEWVDGDGTETFDSRNPANGETLGTFQRGTTTDVEAAIAAADDAEDEWQSLSRIDRAEYLWDIYHELKDRHQELGEVVTKECGKEISEGKADVTEAWQMVEWAAGDARHPKGDVVPSEIPEKDAYMRRQPRGVVGCITPWNFPVAIPFWHMAVALVEGNTVVWKPAEQTPWCGQIIAEMFADAGIPDGVFNMVQGFGDAGARIVDHDDIDTVLFTGSAEVGEEVARTVADDPGKLAACEMGGKNGIVVTEKADLDIAVHAAVMSSFKTTGQRCVSSERLIVHEDLYDEFKQRFVEIAESVAVDDPLDEETFMGPAIEPAHVEKIQTYNDIAREEAENVLVDRTELGDDEIPDGHEDGNWVGPFVYEVDYDPDLRSITEEVFGPHVALIEYSGDIERAVEIHNDTPYGLAGAVISEDYRQINYYRDNAEVGLAYGNLPCIGAEVQLPFGGMKKSGNGYPSAREVIEAVTERTAWTLNNSKDIEMAQGLSADINTDE

SEQ ID NO: 6813 - protein, 337 aa, Magnetospirillum magnetotacticum
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 6814 - protein, 490 aa, Pseudomonas syringae pv. syringae B728a
MARFELQKLYIDGGYVDASNPETFDAINPANGEVLAQIQRAGKDDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 6815 - protein, 640 aa, Vitis vinifera
MISLNSSSFLSNSGFSGISRSVSQRKVLPPVVLALGSNGRAGELNVSAVMESTLKELRDGNTVLEVDSKSAVSGGVRDVQGEDAATEDQIVTPWTITVASGYSLLRNPHHNKGLAFTEKERDHHYLRGLLPPAVVSQDLQVKKLMANIRQYTVPLQKYMAMMDLQERNEKLFYKLLMDNVEELLPVVYTPTVGEACQKYGGILRRPQGLFISLNEKGKILEVLKNWPEKNIQVIVVTDGERILGLGDLGCQGMGIPVGKLSLYTALGGVRPSACLPVTIDVGTNNQKLLDDEFYIGLRQKRATGQEYAELIHEFMCAVKQNYGEKVLVQFEDFANHNAFDLLARYGTTHLVFNDDIQGTASVVLAGLISALNLVGGTLAEHTFLFLGAGEAGTGIAELIALEMSKQTQAPLEETRKKIWLVDSKGLIVSSRMDSLQHFKKPWAHEHEPIKNLVDAVKAIKPTVLIGSSGVGRTFTKEVVEAMASFNEKPIILALSNPTSQSECTAEEAYTWSEGRAIFASGSPFDPVEYNGKVFVPGQSNNAYIFPGFGLGLIISGAIRVHDDMLLAASEALAKQATQENFDKGMIYPPFSNIRKISAHIAANVAAKAYELGLATRLPQPENLVEYAENCMYSPAYRSFR

SEQ ID NO: 6816 - protein, 296 aa, Glycine max
  unsure (1)..(296): unsure at all Xaa locations
WLFEDPRSKDIEDVLILSGDHLYRMDYMDFVQNHRESGADITLSCLPMDDSRASDFGLMKIDNKGRVLSFSEKPKGEELKAMQVDTTRLGLSKDEAQKKPYIASMGVYVFKKEILLNLLRLXWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVSIRIGEXTKIKDCIIDKNARIGKNVVIAHSEGIP

SEQ ID NO: 6817 - protein, 327 aa, Rhodobacter azotoformans
DRLTACDSYRAKAYKVEPVPGTPGQYFCYVAYDLILFEEGSIANLTASIIGNVFSFKPLKAARLEDMRFPVAYVKTYKGPPTGIIVERERLDKFGKPLLGATTKPKLGLSGKNYGRVVYEGLKGGLDFMKDDENINSQPFMHWRDRFLYVMEAVNLASAQTGEVKGHYLNITAGTMEEMYRRAEFAKSLGSVIVMVDLIIGYTAIQSISEWCRQNDMILHMHRAGHGTYTRQKNHGISFRVIAKWLRLAGVDHLHCGTAVGKLEGDPPTVQGYYNVCREPFNTVDLQRGLFFEQDWADLKKVMPVASGGIHAGQMHQLLSLFGDDVV

SEQ ID NO: 6818 - protein, 195 aa, Schizosaccharomyces pombe
NQRGEYTKLEGVWRLQMGLALVPALLVLIPRLTMKESKSYEQSKALNKYTDNDTYIADDDEPKKDNQNVVEEKQINLTTSSDSHPTSTEDFGDKRASTVPTSENTSGFIEYFSQWHHFKHLLATAVSWFLLDIAFYGVNLNQSVILKAIGFSSGKNEYHTLMRGAIGNLIIAIAGYVPGYWFTVFLVEKLGRKWI

SEQ ID NO: 6819 - protein, 335 aa, Agrobacterium tumefaciens str. C58
MTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVFLPHGA

SEQ ID NO: 6820 - protein, 522 aa, Pseudomonas fluorescens PfO-1
MRLKKTEEPEMNSTLGSGIIPRRTIGVLAASLLTLSVNAAPLTRDNGAAVGDNQNSQTAGANGPVLLQDVQLIQKLQRFDRERIPERVVHARGTGAHGTFTTTNDLSDLSKAKVFTAGQVTPVFVRFSAVVHGNHSPETLRDPRGFATKFYTADGNWDLVGNNFPTFFIRDAIKFPDMVHAFKPDPRTNLDDDSRRFDFFSHVPEATRTLTELYSNSGTPASYREMDGNSVHAYKLVNAKGDVHYVKFHWKSLQGIKNLDPKQVEKVQGRDYSHMTHDLVENIQKGNFPKWDLYIQVLNPQDLSKFEFDPLDATKIWPGVPERKVGQMVLNRNPANVFQETEQVAMAPSNVVPGIEPSEDRLLQGRIFAYADTQMYRLGANALQLPINAAKTAVNNGNQDGAMNAGASTSGVNYEPSRLQPREETAGARYSQTALQGSTQQAKIQREQNFKQAGDLYRSFSKKERQDLIESFGGSLASADDESKHIMLSFLYKADPEYGAGVTKVAKGDLSRVKALAAKLAD

SEQ ID NO: 6821 - protein, 90 aa, Mycoplasma genitalium
LVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 6822 - protein, 380 aa, Lactococcus lactis subsp. lactis bv. diacetylactis
MVDFNKVLDLHELHTGVLDIQADIDVKKPSDLAEAYTPGVAELSKLIQSDPEAKRKYTMSGKLVAVVTDGTAVLGLGNMGPAGGLPIVEGKALLYKELAGVDAIPIAVEQIGAEKIIETIKNISQSFAGIHLEDISAPQCFEIEERLSKNLNIPVYHDDQAGTAIVVLAGLMNAAKLVNKKLEDLKIVINGVGAAGVATGRLFAEVGIKNVTLIDIEGKVNDKVKSYNRYQLELAKRFNRVAGTTLDEVIDGQDVFIGLSDAKVLTGTQVERMAKDAIIFALANPVPEILPEEALKHGAAVVATGSNQWPNQVNNVLVFPGLFKGLLSANVQHVDYKLQANIATAIADVIKNPDRNHIVPGVFDAGVVESVTKAVKDSAK

SEQ ID NO: 6823 - protein, 419 aa, Novosphingobium aromaticivorans
MRDTYSQPLARDAMAYVLAGGRGSRLKELTDNRAKPAVYFGGKSRIIDFALSNAINSGIRRIGVATQYKAHSLIRHMQRAWNFMRPERNESFDILPASQRVSEHQWYEGTADAVYQNLDIIASYAPKYMVILAGDHIYKMDYELMLRQHVESGADVTIGCLVVPRIEATGFGVMAVDTSDTITAFVEKPANPPGIPGNEDMALASMGIYVFDTKFLFDILREDAADPSSSRDFGNDIIPKIVRNGKAVAHRFTASCIRAAEEIEEYWRDVGTLDAYFEANLDLTDVVPKLNMYDRDWPIWTDQIIAAPAKFVHDEDGRRGMAISSLISQDCIVSGAIARRSLLFTGVKMGSFSSCEEAVILPYCNIGRGARLSRVILDSGVRIPEGLVVGEDPELDARRFQRTESGVCLITKRMIDQLA

SEQ ID NO: 6824 - protein, 230 aa, Listeria monocytogenes
MYWKVILEQYGTNDPFLNSELGKAMVDGYQGDASKLHENLEQMAACVKHFAAYGAAEAGLEYNTVNMSTRELYQNYLPAYNAAIQAGAKLVMTAFNVVDGIPATMNKWLNRDVLRDEMGFDGVLISDWGAVAEVINHGTARNPKEAAQFSMEAGVDLEMMTTCYIHELKGLIEEGKLSESLLDEAVLRMLTLKNDLGLFEDQHVLLQHVLQMPLPYQVLCSHAPDASRWY

SEQ ID NO: 6825 - protein, 374 aa, Kluyveromyces lactis
MLRLTSARSIVSPLRKGAFGSIRTLATSVPETQKGVIFYENGGKLEYKDIPVPKPKPNEILINVKYSGVCHTDLHAWKGDWPLPTKLPLVGGHEGAGVVVAMGENVKGWNIGDFAGIKWLNGSCMSCEYCELSNESNCPDADLSGYTHDGSFQQYRTADAVQAARIPKGTDLAEVAPTLCAGVTVYKALKSANLKAGDWVAISGAAGGLGSLAVQYAKAMGYRVVGIDGGEEKGKLVKQLGGEAFVDFTKTKDMVAEIQEITNGGPHGVINVSVSEAAMNASTQFVRPTGTVVLVGLPAGAVIKSEVFSHVVKSINIKGSYVGNRADTREAINFFANGHVHSPIKVVGLSELPKVYELMEQGKILGRYVVDTSN

SEQ ID NO: 6826 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 6827 - protein, 548 aa, Triticum aestivum
  unsure (1)..(548): unsure at all Xaa locations
DITWGGGGSSRHGTLHLRHHMQNMVRVEAMVHDTRPHMPVDNIDYALDPLVSWDAQNVRAQRRSPPYGGQTCVKVVGGFLGTPMVVGHMKGKNVVQLGLPAAGGHPTYAWQIPAPXGGTCGPYPTAFAPWTSCVDAAPDLCLSPLSLLADFFXVLVDVALAIALTLPXIVPPPMPITNXKDFRTRGLSCRKRGRPPSLVAPPPFESSAGAVKEHXSHIGLEVCTKKXGIVRKILYQYTLYMGKTPFSILMNLGLIEESTLSRTLPWRPPTNVFRVKEDVRPIFWANRPKSYISRTTGWDQYPHGRWGDSRNPSYGALNDHQFTRPRGPCKKLQEEWAVPLKSVQDINERFVNFCEGKLKSSPWSELDGLQPETTIIDDQLVKINSKGFLTINSQPAVNAEKSDSPSVGWGGPGGYVYQKAYVEFFCAKEKLGQLIEKSKAFPSLTYIAVNKEGESISNIPANAVNAVTWGVFPXGKEIIQPTVVDSASFMVWKDEAFEIWSRGWACLFPXEGDSSRELLEQIQKSYYLVSLVDNDYISGDLFAAFKEI

SEQ ID NO: 6828 - protein, 157 aa, Saccharomyces cerevisiae
MNGGGKNVLNKNSVGSVSEVGPDSTQEETPRDVRLLHLLLASQSIHQYEDQVPLQLMDFAHRYTQGVLKDALVYNDYAGSGNSAGSGLGVEDIRLAIAARTQYQFKPTAPKELMLQLAAERNKKALPQVMGTWGVRLPPEKYCLTAKEWDLEDPKSM

SEQ ID NO: 6829 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 6830 - protein, 340 aa, Zea mays
  unsure (1)..(340): unsure at all Xaa locations
MSGDRSPTVERRRGIRRLLLHPRGEASSSSPPPPAPAPEEGRRKGFATAALRGLGCTSASASQAXYAPGEAAAAAAVRSSADWQGRRRRRGRDRRKERGGGGGGGLGYVTGGIGAEVWCAPXIPFATETSPXTCVVAGHQKVGKCGRGAEGDRSHRERPCLSRRVTVQEQISSSFMDSPPPPHLDAPLFGADLIPSGRLRRMRGWRHSPGGLEEEIRMFQTRVLLGGMNMYDRYQDWRLDVDNMTYEELLELGDKIGYVNTGLRDDEITRNLRKFKHPSFSSLRFATEMERKCSICQEEFETNEEMGRLDCGHSYHVYCIKQWLSQKNICPVCKTAVSKN

SEQ ID NO: 6831 - protein, 325 aa, Bacillus cereus ATCC 14579
MLVISANEQRNLVNMNEVIEYAALALKEFSAERTITPIRGSLPFANEQNTALIMPSVAEGLEALGVKIVTVVPQNKQIGKKTINGIVMLSDFQAGEPLALLEGSYLTMIRTGALSGVATKYLARHNAKTLCIIGTGEQAKGIAEAIFAVRDIEKVILYNRTEEKAYAFAQYIQEKFGKPAYVYKDPNEAVREADIIVTTTNATTPVFSEILQKGVHVNAVGSFRPSMQELPSHAIAKANKVVVESKEAALDETGDLQVPIKEGLFKANAIHAELGQIISGEKAGRENDEEITIFKSVGLAVVDIIVAKYLYERALEQGVGNKIEF

SEQ ID NO: 6832 - protein, 367 aa, Oryza sativa
MEELEGHRGEGRLPPPPPLLPFPKVSVQVYTVPSSSTAASAAAAGGARQDCCTGDAGRRRRRRPRRGVLDDPVKARIVSHPRYHRLLAAFLDCHKVGCPAEAAEEIAAAARVREARQRAAAAASRMPPAPEDPELKLVTEDYCKLLVECKEELSRPLQEAEEFLRTVESELELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 6833 - protein, 335 aa, Desulfitobacterium hafniense
MISSSALLIVVVFFALAFDYINGFHDTANAIATSVSTRALTPKRAIVIAAILNFAGALVSTGVAQTIAKDIVNPDFVTQELVIAALIGAIFWNLATWYFGIPSSSSHAIIGGMIGAAVSKVGFGVLQVQGILKIIAALLVSPIIGIILGFIIMKTLYFIFGKVAPSKVNQGFRKMQVLSAGLLAFNHGSNDAQKSMGIITMALIASGLQDPANLNPALWVKFACAMAMALGTAAGGWKIIRTMGGKIFKLEPINGFAADLTSSIVIWTATAFPGLHLPVSTTHVVSGSIMGVGSAKRISAVRWGVAQQMLVAWVVTIPTSALTSFLMYKLVTLVL

SEQ ID NO: 6834 - protein, 311 aa, Arabidopsis thaliana
MRTGKGNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKGLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 6835 - protein, 500 aa, Burkholderia fungorum
MHTLTSSSVSLLPEVARFLDAGPLGGVIDGRDEQAADGATFETLDPGTGEHLATVAAMGPADVDRAVDAARRAFARSGWATMHPNDRAIWLHRLADEVERRKAIIGQIEALDAGKIEQQAQGDVQSFVDTLRYFNELALNTERRSALPVSGYEAWTTRQPWGACGFIVPWNFPMVLIGWNISPALAAGNTVVIKPAEDTPLSAIYLARLAREIGFPDGVINVVTGLGEIAGAALSRHPGLRRMSFTGSPEVGRMVAEACGRNLVPCKLELGGKGAAVIFDDVNIEETADKLARAITFHTGQVCCDATRWLVHESIFERFVDASVAALQRTKIGYQLDPGAEMGPVVSAKQRERVLGYLERGQRDGARAVLKGGAVDVAGHDGFYVSPALLAGSLENVAAREEIFGPVAFLAPFRDEAQAVELANDTDYGLANSVWSHDPRRASRVAEAMVAGNSWINAHNLFPLGVPYAGVNRSGMGGGVNSVETLFDYWRSQSMVRPTR

SEQ ID NO: 6836 - protein, 387 aa, Oceanobacillus iheyensis HTE831
MKQSNRLKQLPPQFFASLVQKVNQAISEGRDVINLGQGNPDQPTPAHIIKALQSAVEDPITHKYSPFRGTDDFRKAAATFYKREYQVDLDPDTEIAVLFGSKIGLVELPLALMNPNEWMMLPNPGYPDYLSSIPLADIQYDTMPLLEENNFLPNYEQLTLSQKERTKLLYLNYPNNPTGATANNAFFNETVALGKNHDIGIVHDFAYGAIGFNEEKPISFLQTKGAKEVGIELYTLSKTYNMAGWRIGFAAGNKEMIEAINILQDHLFVSVFPAIQRAASEALLSDQSSVQDLVTLYQKRRDALITECKRIGWDINAPQGSFFAWLPVPNGFTSETFADYLLNEVDVAVAAGNGFGTFGEGYIRVGLLVDEQRIVEAIKRIEGLKLF

SEQ ID NO: 6837 - protein, 742 aa, Streptomyces avermitilis MA-4680
MTHPWQDPALPAAVRAADLLARMTPQEKTAQLYGVWPGSDEAPGGDVAPLQHALSEGVDLAGLLPHGLGQLTRPFGTAPVDPAEGAARLGFLQERIRAANRFRLPALAHEECLTGFTAWQATIFPTPLAWGASFDPDLVKEMAAAIGASMRAVGVHQGLAPVLDVVRDPRWGRTEESIGEDPYLVATVGTAYVQGLQSSGVVATLKHLAGYSASRGARNHAPASLGPRELADVILPPFEMAVREGGARSVMAAYNDIDGLPAHAHHRLLTHLLRDEWQFTGTVVSDYFGVSFLESAHGLADSPAGAAALALAAGVDVELPAVRCFGAGPFDEELVDRAALRVLTQKCELGLLDPDWAPPATEAPVDLDPPHMRALARQLAQESVVLLANDRGLLPLAPGARRIAVLGPHADDPAAMLGCYTFPRHVLLDRPGVPMGVAVPTLLEALRTELPDAEFVTDPAAAEVCVVAVGDRSGLFGRGTSGEGCDAADLELPDGQGEVVDRALASGTPVVLVLLSGRPYALGRWADRCAAVVQAFFPGEEGGPAVAGVLSGRVNPSGRLPVSVPRGPAGQPWTYLAPPLGRHGEASNLDPTPLYPFGHGLSYTTYDWQAPSVDDASFPTDGETTLRLTVRNTGERPGTEVVQLYLHDPVGKVARPVVRLVGYARVPLEPGASGEVHFTVPADLAAYTGPDGERIVEPGALELRLGVSSADGDVRYTVPVTLTGPERVVGRERRLRCEVRVK

SEQ ID NO: 6838 - protein, 533 aa, Oryza sativa
MATCAADLAPLLGPVAANATDYLCNRFADTTSAVDATYLLFSAYLVFAMQLGFAMLCAGSVRAKNTMNIMLTNVLDAAAGALFYYLFGFASLRDCLRTPSNGFIGKQFFGLKHMPARPGSDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCGVVDPWAAIICGFVSAWVLIGLNLAARLKFDDPLEAAQLHGGCGAWGILFTALFARQKYVERSTAPAAYGLFMGRRKLLVGAVIQILVIFGWVSCTMGPLFYGLKKLGLLRISGRDETSGMDLTRHGGFAYVYHDEDEHDKSGVGGFMLRSAQTRVEPAAAGCLQQQQPSVTNPEASTSQRRKKSRVSLPLRSRSSRHKFDPHI

SEQ ID NO: 6839 - protein, 480 aa, Paraglossum papenfussii
ARIKNERYESGVIPYAKMGYWDPDYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPYAYLKTFQGPATGLVVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARKNDMILHLHRAGNSTYSRQKIHGMNFRVICKWMRMAGVDHSHAGTVVGKLEGDPLMIKGFYDTLLLPYLDVNLPQGIFFEQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITFNYTSTDTADFVETPTANV

SEQ ID NO: 6840 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKIHHSVVG

SEQ ID NO: 6841 - protein, 251 aa, Neisseria meningitidis serogroup B
MWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 6842 - protein, 495 aa, Escherichia coli
DRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 6843 - protein, 482 aa, Clostridium perfringens str. 13
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGSEIGDYCVTHDKIDFINFTGSTEVGRRISEITVMKPLLMELGGKDAAIVLEDADLDLTVNNIIAGGYSYSGQRCTAVKRILVMNSVADKLVEKLKEKISKLKMGNPLEVEDVTIVPLIDNKAADFVMELIDDAKEKGATLVCGGHREGNLIEATLFDNVTTDMRLAWEEPFGPVLPIIRINDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 6844 - protein, 215 aa, Desulfovibrio vulgaris subsp. vulgaris (strain Hildenborough)
MQFFIDTANLDEIREAARLGLVDGVTTNPTLMSREGHDWRDVAAAICREVDGPVSLEAVGNTADELVAMGLELVRFGPNVVVKVPMTTEGLKAVRILSGQGVDCNVTLVFSPMQALLAAKAGAAFVSPFVGRLDALSEDGMQLVAETLTIFRNYAMPTRVIVASIRHPMHVSRAALLGAHIATIPFGVLGQLAAHPLTDAGLAAFDRDWARLNGK

SEQ ID NO: 6845 - protein, 280 aa, Glycine max
  unsure (1)..(280): unsure at all Xaa locations
MAATSSLCSSTLQSQINGFCLHKTSLSHPRSLTFSRKKISTTVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPXTPLSAIEYILDVVDLVLIMSVNPGFGGQSFIESQVKKISDLRRVCAEKGVNPWIEVDGGVGPANAYKVIEAGANALVAGSAVFGAKDYAEAIRGIKTSKRPEAVAV

SEQ ID NO: 6846 - protein, 442 aa, Pseudomonas fluorescens
RERIHERVVHARGTGAHGTFTVTDNLSDLTKAKVFAAGETTPVFVRFSAVVHGNHSPETLRDPRGFATKFYTAEGNWDLVGNNFPTFFIRDAIKFPDMVHAFKPDPRTNLDDDSRRFDFFSHVPESTRTLTELYSDSGTPASYREMDGNGVHAYKLINAKGEVHYVKFHWKSLQGIKNLDPKQVTEVQGRDYSHMTNDLVAHINKGDFPKWDLYVQVLKPEDLAKFDFEPLDATKIWPDFTERKVGQMVLNRNLDNVFQETEQVPWPPANLVPGIEPSEIRLLQARLCSYAETQIYRLGAKRLQLRIQRPTVTVNNGNQDGAMNFGKDTTGVNYQPKSSDAREEPATARYSESALAGNTQQAKIQREQNFKQAGDLYRSYSKKERQDLIDNFGGSLATTDDESKHIILSFLYKADPEYGTGVAKVAKGDLARVKALAEKLTD

SEQ ID NO: 6847 - protein, 366 aa, Bacillus anthracis str. A2012
MQVKDQLSSLQPYKPGKSPEQMKEVYGDHSFVKLASNENPFGCSPRVLDELQKSWLDHALYPDGGATTLRQTIANKLHVKMEQVLCGSGLDEVIQMISRAVLKAGDNIVTAGATFPQYRHHAIIEGCEVKEVALNNGVYDLDEISSVVDNDTKIVWICNPNNPTGTYVNDRKLTQFIEGISENTLIVIDEAYYEYVTAKDFPETLPLLEKHKNILVLRTFSKAYGLASFRVGYAVGHEELIEKLNVVRLPFNVSSLAQKAATIAFGDDEFIEEIVRVNTEGLRQYESFCKENEIPFYQSQTNFIFLPVENGGEIYEACAHAGFIIRPFPNGVRITVGTREQNEGVISVLQQHFENKKRKSRDEANA

SEQ ID NO: 6848 - protein, 119 aa, Campylobacter jejuni subsp. jejuni NCTC 11168
MKELNEEEKKVILNKGTEAPFSGKYNDFYEKGIYQCKQCGASLYKSEDKFKSGCGWPSFDDEIKGAIKRIPDKDGIRTEIVCANCNGHLGHVFEGEGFSAKNVRHCVNSISLEFVKTKD

SEQ ID NO: 6849 - protein, 417 aa, Shigella flexneri 2a str. 301
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 6850 - protein, 484 aa, GIBBERELLA ZEAE PH-1
MSTNSTKTLNLKDNYVQIINGKSAPTQKTHQGINPATLEKKPEVPVASQDDLNNAVDAARKAFKSWSKVPWEERRQKLFAWADAVEAQKKEFAQLLTSEQGKPVAQANGEADAAVAWIKGQASLDLTEEVVEDSDTRKVVTRYTPLGIVAAIVPWNFPLMLAASKIAPALLTGNVIIVKPSPFTPYCGLKLVELAQQFFPPGVVQSLSGDDNLGPWITSHPGIDKISFTGSTHTGKLVMQSAAKTLKRVTLELGGNDAAVVFPDVDIDSVAEKVSTLAFMNSGQICLNVKRIYVHESIYEKFRDAVVNHVKNYKLGDGSEEVTSHGPVQNQMQYNRVKTFFEDIEKQGWKVATGGKFDPEPKNGYYITPTVIDNPPEDSRIVVEEPFGPILPLLSWKNEEEVIERANDTRLGLGASVWSADLETAERVAKQLDAGTVWVNTHFDITPMAPFGGHKESGIGAEWGINGLKGMCNVQSLFLSKVAA

SEQ ID NO: 6851 - protein, 268 aa, Oryza sativa (japonica cultivar-group)
MMGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 6852 - protein, 490 aa, Detonula confervacea
MSQSVSERTRIKSDRYESGVIPYAKMGYWDAAYSVKDTDILALFRITPQPGVDPVEAAAAVAGESSTATWTVVWTDLLTACERYRAKAYRVDPVPNATDVYFAFIAYECDLFEEASLSNLTASIIGNVFGFKAISALRLEDMRIPHSYLKTFQGPATGIIVERERLNKYGTPLLGATVKPKLGLSGKNYGRVVYEGLKGGLDFLKDDENINSQPFMRWRERFLNCLEGINRASAATGEVKGSYLNITAATMEEVYKRAEYAKAIGSVVVMIDLVMGYTAIQSIAYWARENDMLLHLHRAGNSTYARQKNHGINFRVICKWMRMSGVDHIHAGTVVGKLEGDPLMIKGFYDILRLTELEVNLPFGIFFEMDWASLRRCMPVASGGIHCGQMHQLIHYLGDDVVLQFGGGTIGHPDGIQAGATANRVALEAMVFSRNEGADYFNNQVGPQILRDAAKTCGPLQTALDLWKDISFNYTSTDTADFAETATANR

SEQ ID NO: 6853 - protein, 472 aa, Oryza sativa (japonica cultivar-group)
MRGGGPRRIERSEDKRRLTSPPLRLADPPLYYPPFSAPRHLLLCSPLLLLVQSKLRSSSSKQPNAAHTKLCSSCSSYTRAAAHSVELRAQRGAMGRHKFRLSDMIPNAWFFKLRDMRAARGGAGAGGGGASHGGVVTQSSVAVSRAGRACRPLPNTPRHGALSLPHRASYYYTPRAGDLLVGSPLHPKCSDTQFPPLQLSPPRKSRRRHRRRSVKLAPSVSGSSVLSSPVSTGCRCGRKPELVVVEAPDTPPCRRDKFVGYNDDDDDEEEEEVEFKKPTVAVAACDELDGKVITSATDIIIDLRTEKRPDKVLPPIVTKPARRELDGCDLEEKHIDVVRRASAKKPTTLLEQSKPRRSVSSARRLKTRANTPRIVAKKSKPPPPPPPAAARSPAPTTKPPLAESFAVVKSSRDPRRDFRESMEEMIAENGIRTAADLEDLLACYLSLNAAEYHDLIVDVFEHIWANLADIKM

SEQ ID NO: 6854 - protein, 246 aa, Houttuynia cordata
MGRGRVELKRIENKINRQVTFAKRRNGLLKKAYELSVLCDAEVTLIIFSNSGKLYEFCSSSSMMKTLERYQKCSYSMPEATGPSRETEKSYQEYLKLKGKVEHLQRIQRNLLGEDLGPLSSKELEQLENQLEQSLRQIRSTKTQSLLDQLSDLRRKEQQLLESKKILNKKLAEHGPENPLQLSWQSCGQSNPYSSQPAHSEAFFQPLDCNPTLQIGYPSVGQEQIMAAPATAAPQNANGFIPGWLV

SEQ ID NO: 6855 - protein, 304 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDQDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELE

SEQ ID NO: 6856 - protein, 378 aa, Oryza sativa (japonica cultivar-group)
MDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 6857 - protein, 556 aa, Zea mays
  unsure (1)..(556): unsure at all Xaa locations
MAAQVVVAGGGGSWPQQWRLTLVLAALVPLLSLCLLLARTTRRAGSWSSSSKGGRLDVHRLPPGPPRLPLLGNLHQLGSLPHRSLRELARRHGPVMLLRLGSVPTLXGVSSXXXXXXXXXARDADCCXRPDTPGARRLSYGHKDVAFAPYTDYWRQMRKLFVVELLSARRVRAADHAREAEVDKLIARLSSAGGKPVQLEDHMFALMDGVIGTVAFGNIYGAEQFAHRNHFHDVLDEALSAKAGFSAEDYYPNAAGRLVDRLTGAAARRERVFRDLDAFFDTIIDQHLVVVDPSSSPPSSATTTPDLIDVFVDLMEESRHQPQVHGSLRFTRDHIKGLLSNVFTAGVDTSSVTMVWAMAELTRRPAMLRKAQEEVRSVVGGDRERVHPDDMPKLRYLKAVVKETLRLHPAAPLLLPRETMRHVSVCGYDVPAKTRVLVNAWAIGRDPRSWGPRAEEFDPGRFEDGGDVGFNGTHFELIPFGAGRRMCPGIAMGVATMEFTLANLLYCFDWELPEGVGVEDVSMEEAGSLTVHKKTPLLLVPTRYKANCQSRHSFQF

SEQ ID NO: 6858 - protein, 430 aa, Grateloupia filicina
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVMARNEGRDYVGEGPQILQDAAKTCGPLQTALDLWK

SEQ ID NO: 6859 - protein, 396 aa, Dechloromonas sp. RCB
MNPHLAQLQPYPFEKLRALFAGVTPNPQYKEIKLSIGEPQHPTPAFIMDALANGLKGLANYPTTQGIPLLRQTIAKWCRHRYGLELNPETEILPVNGSREALFSFAQTVIDPSRGHVPLIVSPNPFYQIYEGAAYLSGAEPRFLNNLPDNDFAFDYASLSEEEWARVQLFYVCSPGNPTGKVLSLADWKTLFALSDKYGFIIASDECYSEIYFDEANPPIGGLQAAKLLGRTNERLVMFSSLSKRSNVPGMRSGFVAGDEKILKKFLLYRTYHGCAMAPPVQTASIAAWNDESHVLDNRNQYREKFAACTPLIGEVLGTGMPDASFYLWAKTPIADTEFARGLLEHYNVVVLPGSFLAREVRGVNPGANFVRIALVASLDECLEATQRIRQFAQQL

SEQ ID NO: 6860 - protein, 349 aa, Triticum aestivum
  unsure (1)..(349): unsure at all Xaa locations
MAGIRWPPEDPEMFPTRMLGTGVWGGPPAAAAGGGGGPPGPPGEMASDDDRSVAADSXWSIKSDYGSTLDDEQRYADTAEVLLASCPSSASSSAASAAAPSACSSSLSAHHSSDFSFDKDVPDVVPPMLGLHNYQDGAYAEDLANYHERSHADDWFGTEAMDVLVGWTKNLCSSKDLPGCSVLDIGTGSGRLLQQLAKQGFSELPGIDYSEAAIELARNLAIRDGFEHINFLVDDVLESKLERRFELVMDEGTLDAIGLHPDGPVKRGRYWQSVASLVSPGGILVITSCSRTKDELVQEVENFNQRKLGATLSEGALASDAVVFKYLDHVQAYPNVDGVCIATVAFLHT

SEQ ID NO: 6861 - protein, 102 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARR

SEQ ID NO: 6862 - protein, 191 aa, Triticum aestivum
LCPPPAPPFSPLRSSSRARVFIRVSGRGMADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGGYAQGMGYMQPQYHNGDT

SEQ ID NO: 6863 - protein, 477 aa, Gracilaria salicornia
KKNRYESGVIPYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAATGEVKGHYMNVTAATMENMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVLARNEGRDYVAEGPQILRDAAKTCGPLQTALDLWKDITFNYTSTDTADFVETPTANV

SEQ ID NO: 6864 - protein, 418 aa, Aspergillus fumigatus
MRAAEHLEAAALPMRKRVANESVTTKMTGRTSCSTRTRTPTAQDLRSILKARSRNPHDFRGRMQTQPICTDMMYDRRHQIELKKLFCKFRNTHVHTQKDLGPENMFVGVGSDEAIDALLRCFCVPGKDKILTCPPTYGMYAVSAEVNDVEIVKVPLDVNNGFQLQPDKINEALSADPTIKMAYICSPGNPTANLIRKEDIQKVLEHPTWNGVVIVDEAYIDFAPEGSSLAEWVTEWPNLVVMQTLSKAFGLAGIRLGVAFTSPEIARLLNSLKAPYNISSPTSAIATAALSPENMAVMRNYREQIIAQRKRMLQELPKIPGVGRFLGGQESNFLLVEMLDKPASEGGKPSNAVALAAYEAMAEKRGVVVRFRGKELGCEGCLRITVGTEQEVTRFLRELRAVLDGLLKGVESNQSGTR

SEQ ID NO: 6865 - protein, 456 aa, Eremothecium gossypii
MGQILSNPVIDKEQGRSGDALTAYGMCAMQGWRMSMEDSHIVDLDISPEGSDDHIAYYCVFDGHGGASVAQFCGEQFSRILQQQKDFGGDAPNFARALVAAFIAADEELLKDPVLANDHSGCTATTLLVSHKQQLLVCANSGDSRTVLSTDKNAKALSFDHKPTLRSEQSRIMAADGFVEMDRVNGNLALSRAIGDFEFKSNPNLAPHEQIVTCVPDVLEHKLDYEKDEFVILACDGIWDCLSSQECVDLIHYGIQQGMGLQDIASRVIDVCCSPTTEGTGIGCDNMSFIVVALLRENETEDQWFERMRAKKYQGLLSFEAQRRKVFSYHYDFINEDDDNLFDISTKRPEERNRGSGSLPPMHATTREDPDEEDGANPADGRQHLYSLEELINAGGIQITQGGNNTSYIHGSALSEVLASLVGATGGIVARPAQRADAEDNVSEEQDGKKLEEIQE

SEQ ID NO: 6866 - protein, 467 aa, Ferroplasma acidarmanus
MSSAIDRSMDEAKTSKFHYKVLFISGLGFFTDAYDLFIIGVVILLLPYAGWHNISIFYKGLVTSTALLAAVIGSVVFGRLLDYSGRKAIYGFELVALIAGSLGSAFLTPVNNIFMLLFWRFLLGVGIGGDYATSSTIMTEYSSTMNRGKFVGMIFSMQSFGLIAGPLISIAFLSNYVSPYITWRLLLAIGAIPAIIVIYFRRTMPEPPRYTADVRGDYKLAAKNLKTFAGLDSTGSKGKTINAPWYVLFRDRKFLLTLIGTAGAWFLMDWAFYGNSIMSNSILSFLVPSTVSGIHSIIMTNEYSAIIFGVAAFPGYWIAAFTIDRIGRKPVQITGFAMMAISFGIISAFSFLTTYRFLDYFLLLYGISYFFIMFGPNVTTFVYPPEVFPISTRGLGTGISAAGGKTGAFIGTLADTIILSITGLHFLMGMLAIIAAIGLILTIVLLPETKRRDLGETSGEARYAEWK

SEQ ID NO: 6867 - protein, 227 aa, Tsuga canadensis
NTGPEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAAESLDYILDTIPVAHP

SEQ ID NO: 6868 - protein, 482 aa, Streptomyces avermitilis MA-4680
MSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 6869 - protein, 221 aa, Zea mays
  unsure (1)..(221): unsure at all Xaa locations
MGSSSHSLAVSRRGRSARQSPFFRDLATPIPSHRGVSRFASGASPSSTPPPPPPIFTLDDRYASADFSPDPTASDLLPVASSPSPRTAASRSPPWDLSRGKVALSAPGSPMAGVVEPTRKEMLALPAPASPGTPPPAATAEAQSPVSPAQAPRTEPVANAGEVEREEWVTXFGXFIGGXHLILWGFGKCGVILGHYFGPXGGYWVPFLVQGFLWWFERPFL

SEQ ID NO: 6870 - protein, 144 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 6871 - protein, 454 aa, Oryza sativa
MGLDLGALVLKSGGLLVSDYDSIVAINIFVALLCSCIVIGHLLEGNRWVNESITALVMGSGFEFCSVGWRLQGLITGGVILLVSGGKNSHILVFSEDLFFIYLLPPIIFNAGGLGDDWIQVCLIILTFLLNVSKLVLNQDETPLLYSLVFGEGVVNDATSVVLFNAIEDIDIANFDSLVLLAFIGNFLYLFFTSTLLGVVLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 6872 - protein, 399 aa, Xanthomonas campestris pv. campestris str. ATCC 33913
MHTALSRRRFLRDSALFAGAAGGALPLLASAAERSAAIAPAAAGAMAPVMIGSNEFPDGPCAAAIKAITQIAPQGGRYLRELQMELMTTLAAELKLPVNHLMAYAGSTEPLDYTMLAFTSPSAALVSADPTYESGWRAASRNGAKLVKVPLRKDFSHDVQAMCAADANAGVIYICNPNNPTGSVTARKDLDYALAHKPKDSILVVDEAYIHFAQSTRSVVDMVAAGEDVVVLRTFSKLYGMAGIRLGYAAARPDLLAKLMFYSVNSLPVTAAAAGLASLRDATLVPQRRARTAATRADVIDFLTKQGYACTASESNCFMVDVKQPAAGFKDAMATFGVFIGRSWPVWPTWSRITVGTPEEMARFKQAFVQVMAGKRGPLPLPDATASVQTPMDAFFRYA

SEQ ID NO: 6873 - protein, 353 aa, Oryza sativa
MAASSSRSPASTSRRGGGARQSPFFRDLASPIPSHRAASRFASSAAGPTAATTPPPPPLFTLDDRAAAVDFSPDAAASELLLPVASSPSPRSAAAAASRSPSWDRSRGRASAPGSPMDGVVEPPRKEVLALPPPPSPGTPAPPPPAAEAQSPVTPAPVSTGMEQEMNGGGEVDREEWITVFGFSLKDTNLVIREFEKCGVILRHHSGPRDEFHIVDMTKLTIFSPGLGLILTIMFVYLALKHSYDARKALQKNGVQLSSGVIIGVKPIDPMHRQQLDERFAGNKQGGFMVSLPPKSLVLKGTGASNQLGALPRPYDPKANTNVIRDANRRATGSVAAPAKSLVTNVMDLIFGI

SEQ ID NO: 6874 - protein, 278 aa, Arabidopsis thaliana
QNLKPGSSKWDEVKADVLKALEDYGCFEAFFDKLSVELNRSVFEAMEDLFELPIPTKQRNVSSKPFHGYLCHNLYESLGIDDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 6875 - protein, 254 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETAMRGKLLLEQFGNVWHPSRVRKYLTQDDWSPTETKGRPWFGLLALLRKYPEHFVINTRSKGRMTSEFVSLVSLLS

SEQ ID NO: 6876 - protein, 216 aa, Listeria monocytogenes EGD-e
MAKIVPSVFGADIGRINEQLQVLEKNDIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNDELAKECTLAGADLIVVGSYLFEGDIEANLEKLAKGVLTE

SEQ ID NO: 6877 - protein, 336 aa, Desulfitobacterium hafniense
MSVRVAINGFGRIGRLTLRAILKQSLPVEVVAINDLGSPDLLAHLFKYDSLHGILPNSVEIDGDTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSMIPTTTGAAKAVTLVIPELAGKMNGLAVRVPTPNVSLVDFVANLTKSTSKEGVNAALREAAEGKLKGYLEYTELPLVSRDFNGNSASSIVDGLSTMIIGERMVKVLAWYDNEWGYSNRIVDLVKLIVMKGL

SEQ ID NO: 6878 - protein, 374 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 6879 - protein, 42 aa, Pseudomonas sp. M19
VLNLDKCIGCHTCSITCKNVWTSREGMEYAWFNNVESKPGIG

SEQ ID NO: 6880 - protein, 430 aa, Leptospira interrogans serovar lai str. 56601
MGIGMIMKWTKRLLLLLTLLLPFVLFGQEASTPVADKGDTVWMIVASALVFFMIPGLALFYGGLVRSKNVLSTMMHSFVAILVLTLQWTIFGYSFAFSGTNPYFGNFDLAFLNGIDENTLELTIPKYIHFLFQGMFALITPALISGAIAERVKFGGYIIFILLWSTLVYDPVAHWVWAADGWLFKMSALDFAGGTVVHLISGIAGLAAAIVLGKRKGEGPALIAPNNLTYTLIGAGLLWFGWFGFNAGSGLAVNGITARAFLVTLIAPAAAGVAWLVIEYFHTKKATALGAASGIVAGLVVITPASGFVGVQGAIIMGLLVSPVCYAAILLKGKLGYDDSLDAFGIHGVGGALGAVLTGVFTLTLGAGVASKGDQILVQLISVAATGAYSFIVSMILVFLIDKTIGFRISEEKEITGLDSEIHGEKGYIL

SEQ ID NO: 6881 - protein, 115 aa, Casuarina equisetifolia
ACLNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVP

SEQ ID NO: 6882 - protein, 348 aa, Glycine max
MNAESPPGLLMSVSCLSDYDLLCGEDSSGILSGESPECSFSDIDSSPPPPSPTTEDCYSIASFIEHERNFVPGFEYLSRFQSRSLDANAREESVGWILKVHAYYGFQPLTAYLAVNYMDRFLDSRRLPETNGWPLQLVSVACLSLAAKMEEPLVPSLLDLQIEGAKYIFEPRTIRRMELLVLGVLDWRLRSVTPLCFLAFFACKVDSTGTFIRFLISRATEIIVSNIQEASFLAYWPSCIAAAAILTAANEIPNWSVVKPENAESWCEGLRKEKVIGCYQLMQELVINNNQRKLPTKVLPQLRVTTRTRMRSSTVSSFSSSSSTSFSLSCKRRKLNNRLWVDDKGNSE

SEQ ID NO: 6883 - protein, 437 aa, Leptospira interrogans serovar lai str. 56601
MKFYRRKVEFEKHGKNRMREKSLQYHALHPKGKIEVVPTKPTEDSYDLSLAYSPGVAYPCLEIKDSPELVYEYTNKGNLVGIITNGTAILGLGDIGALAGKPVMEGKAVLFKKFAGIDVFDIEINTKDPDEFIRAVKLLEPTFGGINLEDIKAPESFYIEEQLIEKMNIPVFHDDQHGTAIITVAGLLNSFKLTGKNPDDVKVVICGAGAAGIAIAELIQHIGIKKEQIFLVDTKGVIHHNRNDLNDSKKKYIQKTDSTTLRDVMKGSDIFIGVSVENMVDEDMVRSMSKNPVIFALANPDPEIPYRVAKAVRSDLIMGTGRSDNPNQVNNVLGFPFIFRGALDVRARHITLEMKLAAARSLAELARLEVPEVVSKAYGGEKFTFGPEYLIPKPFDKRVLFHVAPAVAEAAVASGSARIPYLGREKYLGFLEGIIKS

SEQ ID NO: 6884 - protein, 574 aa, Vibrio vulnificus CMCP6
MTAMLSGAEMVVQSLIEENVEQIFGYPGGSVLDIYDALHAKTEQIKHVLVRHEQAATHMADGYARATGKPGVVLVCSGPGATNTITGIATAYMDSIPMIVISGNVPNSLIGNDAFQECDIVGVSRPVVKHSFLVKRAEDIPETIKKAFYIATTGRPGPVVIDLPKDVMNPLIKLPYEYPKSISMRSYKPTTSGHKGQIKKALKALLEAKKPVLYIGGGAIISGAHESILKLAETLNLPVVSTLMGLGAFPGTHKNALGMLGMHGKYEANMAMHNADLIFGVGVRFDDRTTNNLEKYCPNAKIMHIDIDPSSISKNVKVDLPIVGSAEQVLETMVTLLEEQGAENDTQALASWWDEIEGWKARDCLAYDTSSERIKPQQVIETLHKLTNGDAYVASDVGQHQMFAALYYPFNKPRRWINSGGLGTMGFGLPAGMGVKFAMPEEEVVVVTGDGSIQMNIQELSTAMQYDIPVKIINLNNRFLGMVKQWQDIIYQGRHSNSYMSSVPDFAAIAEAYGHVGIRIETPDQLESELKRALDMKDRLVFVDINVDETEHVYPMQIKGEGMDKMWLSKTERT

SEQ ID NO: 6885 - protein, 255 aa, Petunia integrifolia
MSTSNASTSGVRKGAWTEEEDLLLRECIEKYGEGKWHLVPVRAGLNRCRKSCRLRWLNYLRPHIKGGDFSLDEVDLILRLHKLLGNRWSLIAGRLPGRTANDVKNYWNTHLRKKLIAPHDQKQESKNKAMKITENSIIKPRPRTFSRPAMNHVSCWNGKSCNKNTIDKNEGDTEIIKFGDEKQKPEESIVDGLQWWANLLANNIEIEELVSYNSPTLLHEETAPSVNAESSLTQEGGSGLSDFSVDIDDIWDLLS

SEQ ID NO: 6886 - protein, 637 aa, Pseudomonas aeruginosa UCBPP-PA14
MARHQPLPRALRQARPRRRDRRLRLQPELRALPRPGSQVRRHRPGPAPAGDRRRGRRMVQGAGHQRRGARWRGVHAEDGRLHQPGRPLGDPQLSGKRARRRVTRPTLRRRPRRPCTSPPRHGGTTTQESFAMIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 6887 - protein, 141 aa, Zea mays
  unsure (1)..(141): unsure at all Xaa locations
MMQELSLECFSNEVVRLDLTPPSQTSPTSLSIDEEESSEAKIRRLISEHPVIIFSRSSCCMSHVMKRLLTTIGVVPTVIELDDHEVSSLPMALEEEFSGGVLPSPAVFIGRECVGGIESLVALHLSGHLVPKLVXSGALWV

SEQ ID NO: 6888 - protein, 478 aa, Geobacillus kaustophilus
MPIAVQKQKLYINGEWREGKSYTELKSPYSRETIAEIPVATEQEVDEAIAAAYAARQTMAAMPAHERAAILERVGEQLKARQEEAARLIALEAAKPIITAKGEVARTIQTYKFAAEEAKRIHGETLPLDAAPGGEHRIALTVREPIGVIGAITPFNFPMNLVAHKLGPAIASGNTVVLKPASQTPLSAYFIAELFEKAGLPKGALNVVTGSGRTVGDKIVTDPRISMITFTGSPEVGIAIRNKAGLKRVTLELGSNSAVIVDEQVDLDRIIPRCVFGAFTFQGQVCISLQRIYVHENRYDEFVEKFVAAAKQLKTGDPLDPTTDVSALITPNDVDRALSWIEEAKQGGANVVLGGERDGNILLPTVIVDAEPTMKVSCQEVFAPIVLINRVRSIDEAIELVNDSRYGLQAGIYTDNVHTAWKAAKQLHVGGVLINDIPTFRVDHMPYGGVKESGFGREGVRYAIEEMTELKLIIFNES

SEQ ID NO: 6889 - protein, 486 aa, Pseudomonas putida
MKEFLNFINGEYVRNASGKTFQDINPVNGQVIGNIYEAGQVEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNAVGMPKGVYNVVHGFGPASAGEFLTKHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 6890 - protein, 147 aa, Mycoplasma pneumoniae
HRSGLSEHDWEGMETLTKHWSTHQIVGDDLYCTNPAIAEKGVAHKATNSILIKLNQIGTLTETIKAINIAKDANWSQVISHRSGETEDTTIADLAVAACTGQIKTGSMSRSERIAKYNRLLQIELELGNNAKYLGWNTFKNIKPQKA

SEQ ID NO: 6891 - protein, 197 aa, Nicotiana benthamiana
MDTSQLNEALTSKSFDKIADICDNLLLQGAAEGIDCQDEWPYTIHLLGHIYNNDINSARFLWKKIPAALKEGRPEVVAVWRIGQKLWTRDYVGVYEAIREFSWTPEVQPIVASFAELYRKRMFELLLSAYSTISPQDTAQFLGMNENDATNYVLQQGWVLDPASQMLTVKKQAVVTEQKLDPSKLQRLTEYVFHLEH

SEQ ID NO: 6892 - protein, 112 aa, Petunia x hybrida
MAGKLSIVLFVLLVVLLAQNQVSRAKMVLDSKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 6893 - protein, 415 aa, Polysiphonia brodiaei
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQIGTVIIMIDLVIGYTAIQTMAIWSRKNDMILHLHRAGNSTYSRPKIHGMNFRVICKWMRMAGVDHIHAGTVVGKLEGDPLMIKGFYDTLLGPYLDINLPQGIFFQQDWASLRKVTPVASGGIHCGQMHQLLDYLGNDVVLQFGGGTIGHPDGIQAGATANRVALESMVIARNEGRDYVTEGPQILLDAAKTCGPLQTALDLWKDITF

SEQ ID NO: 6894 - protein, 321 aa, Prymnesium parvum
SKVGINGFGRIGRLVCRAAMMKEGAEVVAVNDPFCDVKYAAYLFKYDSTHGIYKGTVECDEASQMLIVDGKKIAFLAVKNPTEVPWGEKGADIVCESTGIFTVIEKASMHLQGGAKKVIISAPSADAPMFVMGVNHTDYKKDINILSNASCTTNCLAPLAKIIHDEFGIVEGLMTTVHATTATQKTVDGPSGKDWRGGRGAGQNIIPSSTGAAKAVGKVIPSLNGKLTGMAFRVPTPDVSVVDLTVKLGKETTYDAIKALVKAKAATPEWKGIMGYTEDEVVSTDFQGDSHSSIFDAKAGIMLTPTFVKLVSWYDNEWGYS

SEQ ID NO: 6895 - protein, 871 aa, Phaeosphaeria avenaria
MALAVAFFVTQVLAQQYPTSNTSSPAANSSSPLDNAVSPPFYPSPWIEGLGDWEAAYQKAQAFVSQLTLLEKVNLTTGTGWQSDHCVGNTGGVPRLNFTGICNQDAPLGVRFADYVSAFPSGGTIAAAWDRGEWYLRGYQMGSEHRSKGVDVQLGPVVGPLGRNPKGGRNWEGFSPDPYLSGIASAESVRGIQDAGVIACTKHYIMNEQEHFRQPGNFEDQGFVDALSSNLDDKTLHELYLWPFADAVRAGTGSIMCSYNKVNNSQACQNSYLQNYILKGELGFQGFIMSDWDAQHSGVASTFAGLDMTMPGDTDFNSGKTFWGTNFTTSILNGTVPQWRLDDAVTRIMAAFYYVGRDKARIPVNFDSWSRDTYGFDHYYGKAGYSQINSHVDVRADHFRSIRRTAAMSTVLLKNEGALPLTGSEKWTAVFGDDAGEGQLGPNGFPDHGGNNGTLAMGWGSGTSDYPYLVTPLESIKATVAQNGGIVTSVTDNWAYTQIQTLAKQASVAIVFVNADSGEGYITVDGNAGDRNNLTLWQDGDTLIKNVSSLCNNTIVVIHSVGPVLVNSFYDSENVTAILWAGLPGQESGNAIADILYGRHNPGGKLPFTIGSDAAEYGPDLIYEPTNNSSSPQDNFEEGVFIDYRAFDKQNVTPIYEFGFGLSYTKFSYSNLTVKKANAGAYTPATGQSKAAPTLGNFSTDASQYQWPSDFTYIDTFIYPYLNSTDLKTASQDPEYGLNYTWPAGATDGTPQARIPAGGAPGGNPQLWDVLFSVEATITNNGTVPGDEVVQLYVSLGNPDDPKIVLRGFDRLSIQPGKTATFHADITRRDVSNWDVASQNWVITSAPKTVYVGASSRKLPLTATLDTSDFQ

SEQ ID NO: 6896 - protein, 303 aa, Bacillus anthracis str. Ames
MSVKKDWIAPLALLFVSFIWGATFVVVQNAMSFVGPFTFNGIRFLFAGIILLFVQILFSKKASKQHIKQSSLAGLIVGFFLCIGYVLQTFGLLYTTSSKAGFLTGLSIVMVPILSFIFLKQKATIFIVIGIAVATAGLYLLTAGDSFQLNIGDILVLGCAVAFAAHILVNGFFSKKISPLLLSTSQVLAVGLFSSICAFLFEDWEKLFSVALWTNSSFLFALFLTSLFATSIAFFIQTSAQKHTSPTRVAIIFAMEPVFAALTGVLVANEQLSISAIIGCLCIFLGMVFVELPSKTKKEAQAA

SEQ ID NO: 6897 - protein, 788 aa, Triticum aestivum
MTTDQPVISLRPGGGGGGPRGGRLFAPAFAVAASGSGDFLRPHGGGASGVSRIGDLHSESRERVRYSRDQLLDLRKITDVTEQILRLQQEIEAELNGDDQSWVRNDSNVQLQTQAQPQVQAQNRFTETDNRDWRARTEKPPAPAVQEEKSWDNIREVKEQYNASGRQQEQFNRQDQSSSQKAQVGPPPALIKADVPWSARRGNLSEKDRVLKTVKGILNKLTPEKFDLLKGQLLDSGITTADILKDVISLIFEKAVFEPTFCPMYAQLCSELNDNLPTFPSEEPGGKEITFKRVLLNNCQEAFEGADSLRVEIASLTGPDQEMEKRDKERIFKLRTLGNIRLIGELLKQKMVPEKIVHHIVKELLGSDKKACPDEEHVEAICQFFNTIGKQLDENPKSRRINDTYFVQIRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRSRSMPRGDPLRNQGPLINKVPSINKPSPINPRLLPQGTGALIGKSALLGTGGPPSRPSSLTASPTPLPAQTTASPKPSSATPASVPIPDKAASSAKVIPAGLQKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVVARLILSCGLRFEAAEGILKAMEDTFFRKAIFTSVTKTLGADPAGQAILSSHAAVVDACNSLSI

SEQ ID NO: 6898 - protein, 613 aa, Arabidopsis thaliana
MQIHFHHHQYHHQLHSHHPWPISHLYMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVL

SEQ ID NO: 6899 - protein, 388 aa, Picea mariana
MGRAPCCAKVGLNKGAWSAEEDSLLGKYIQTHGEGNWRSLPKKAGLRRCGKSCRLRWLNYLRPCIKRGNITADEEELIIRMHALLGNRWSIIAGRVPGRTDNEIKNYWNTNLSKKLAVRGIDPKTHKKVTTDSINRASDRFNQRKGGKLYDCSQRSQRLERNVARAGQSTGLVIPNVHNLKADLKGQYIAGPRAIQSSNSIRSSSPINTLIQPKSNELTDDPDFMQPQPVVSSEAGKQTDDSTVYCSSDSAASCALIDHLSSADDDQYLSLEGNSNECYSHTVAEESGTLKSSNPQTHSEAICDSRERDNGGPVQKHDQFPEYDVLSFFDVRNAENEICCNDDQWVHEQEMPQLHSWDNQIDDQGKEHFGSHVNNDVTAMSWEASFWF

SEQ ID NO: 6900 - protein, 138 aa, Zea mays
QSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSTVQIGGALLTLVAIYMVNYKSIIGEK

SEQ ID NO: 6901 - protein, 363 aa, Coxiella burnetii RSA 493
MALITLRQLLDHAAEHGYGVPAFNVNNLEQVRAIMEAADETKSPVIVQASAGARQYAGPQFIRALIVAATEEWPHIPICMHQDHGASPAVCQRSIQLGFTSVMMDGSLLEDQKTPSDYEYNVHTTALTTQMAHACGVSVEGELGCLGSLETSRAAEEDGSGAEGELSRDQMLTDPEQAADFVNKTKVDALAIAIGTSHGAYKFSRPPTGEVLVIDRIKAIHERLPDTHLVMHGSSSVPQEWLQIINEYSGEIPETYGVPVEEIQKGIRHGVRKVNIDTDLRLASTGAIRRYLAKNPSQFDPRKYLGEAQKAMQAICKARYEAFGTAGQAEKIKIISLENMAGRYKDGELDPRIQNIQPVSSGA

SEQ ID NO: 6902 - protein, 359 aa, Trichodesmium erythraeum IMS101
MAIVPMRLLLDHAAENGYGIPAYNVNNMEQIQSIMQAAEEADSPVILQASRGARKYAGENFLRHLILAAVETYPHLPIAMHQDHGNAPSTCYSAMRHGFTSVMMDGSLEADGKTPASFEYNVNVTSEVVKVAHSIGVSVEGELGCLGSLETGMGDKEDGHGAEGKLSHDQLLTDPDEAVQFVEQTQVDALAVAIGTSHGAYKFTRKPTGEILAISRIEEIHRRLPNTHLVMHGSSSVPEDLLAIINEYGGKIPETYGVPVEEIQKGIKSGVRKVNIDTDNRLAITAAIREAAAKDPSNFDPRHFLKPSIKYMKQVCLDRYQQFGTAGNASKIKVQTLDEFADRYARGELAATTKTAVAV

SEQ ID NO: 6903 - protein, 209 aa, Oryza sativa
MAAATAAAETPPTLLEYMGQAGAADDLVVLVAHVQSACKRIAALVASPGNAELSRGKAGGGVAVAAGRDAPKPLDELSIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 6904 - protein, 177 aa, Glycine max
LSLSRWVNLKAVKRLVEADALKMEIIPNPKEVDGVKVLQLETAAGAAIRFFDKAIGINVPRSRFLPVKATSDLLLVQSDLYTLQDGLVIRNQARANPENPSIELGPEFKKVSNFLSRFKSIPSIVELDSLKVAGDVWFGAGVILKGKASILAKPGVKLEIPDGAVIADKEINGPEDL

SEQ ID NO: 6905 - protein, 351 aa, Yarrowia lipolytica
MTTIPKTQKAVIFETSGGPLMYKDVPVPVPADDEILVNVKYSGVCHTDLHAWKGDWPLDTKLPLIGGHEGAGVVVAKGKNVTTFEIGDYAGIKWINKACYTCEFCQVAAEPNCPKATMSGYTHDGSFQQYATANAVQAAHIPKNCDLAQVAPILCAGITVYKALKTAGLKAGEWAAVTGAGGGLGSLAVQYAKAMGYRVLAIDTGADKEKMCKELELGAEVFIDFAKSKDLVKDVQEATKGGPHAVINVSVSEFAVNQSVEYVRTLGTVVLVGLPAGAVCKSPIFQQVARSIQIKGSYVGNRADSQEAIEFFARGLVKSPIIIVGLSELESVYKLMEEGKIAGRYVLDCSK

SEQ ID NO: 6906 - protein, 369 aa, Oryza sativa
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNFRY

SEQ ID NO: 6907 - protein, 94 aa, Triticum aestivum
MAAASSAPFFGLSDAQMQPLMPAQQPPAPAAAAPAPKKKRNQPGNPNPDAEVIALSPRSLMATNRFVCEVCGKGFQREQNLQLHRRGHNLPWKL

SEQ ID NO: 6908 - protein, 334 aa, Microbulbifer degradans 2-40
MLEAVDAKFKLGLKFEEDLIGGCAIDVHGVPLAQSTLDRCKAADAVLMGSVGGPKWDALDSNIRPEKGLLKIRYEMGLYANLRPAILYPQLADASSLKPEIVSGLDILIVRELTGGIYFGEPRGIRLLDNGERQGYNTYVYAEHEIERIGRTAFEMAMKRDKKVCSVDKANVLEATVLWREVIQSISKDYPEVELSHMYVDNAAMQLVRAPKQFDVVVTGNMFGDILSDTAAMLTGSIGMLPSASLNQDSKGLYEPVHGSAPDIAGQGVANPLATILSAAMMLRYSLNEAAAADAIEAAVGAVLDDGLRSADIFSEGMKKVSTQEMGDAVAAKI

SEQ ID NO: 6909 - protein, 521 aa, Triticum aestivum
MAAATSPAVAFSGATAAAMPKPARHPLPRHQPVSRRALPARVVRCCAASPAATSAAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNALLNGSKAQQGLDFGPWHKELDQQKREFPLGFKTFGEAIPPQYAIQVLDELTKGEAIIATGVGQHQMWAAQYYTYERPLQWLSWSGLGAMGFGLPAAAGAAVAKPGVTEVAIGGDGSCLIHILD

SEQ ID NO: 6910 - protein, 261 aa, Platismatia glauca
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVS

SEQ ID NO: 6911 - protein, 437 aa, Zea mays
MEVHADVDGSGVPLAVLLKRELCNQKVERPDILFGEANKSKKGEDFTLLLPRCHRTTGEGGGSGGGENAGGGDDDDTISVFAIFDGHNGSLAAIYTRENLINNVLAAIPPNLTSEEWTAALPRALVAGFVKTDKDFQTKAARSGTTVTFVIIDGWVVTVASVGDSRCILESAEGSVYFLSADHRLDANEEEVERVTASGGEVGRINIAGGAGIGPLRCWPGGLCLSRSIGDIDVGEFIVPVPHVKQVKLSNAGGRLVIASDGVWDALCFQEALNYIRGLPAEAAANRIVKEAVTSKGLRDDTTCIVVDILPPEKLSPPLKRPGKGVIKTLFRRRPSDEMSEDQMDRGCLEPDVVEEIYEEGSAMLARRLNINYPSGNMFKLHDCAVCQLEMKPGEGTSVHGNMPKHSRVDPWGGPFLCSSCQLKKEAMEGKLHSRTE

SEQ ID NO: 6912 - protein, 542 aa, Nicotiana tabacum
MAARVFTSRLSRSLTSSSHLLSRGLIIVDKQKSHLGRIAAYQYSTAAAIEEPIKPAVNVEHTKLFINGQFVDAASGKTFPTLDPRTGEVIAHVAEGDAEDINRAVAAARKAFDEGPWPKMNAYERSKIFVRLADLIEKHNDQIATLETWDTGKPYEQAAKIEVPMVVRLLRYYAGWADKIHGMTIPADGPYHVQTLHEPIGVAGQIIPWNFPLLMFSWKIGPALACGNTVVLKTAEQTPLSAFYVAHLLQEAGLPEGVLNIISGFGPTAGAPLCSHMDVDKLAFTGSTDTGKAILSLAAKSNLKPVTLELGGKSPFIVCEDADIDTAVEQAHFALFFNQGQCCCAGSRTFVHEKVYDEFLEKAKARALKRTVGDPFKSGTEQGPQIDSKQFDKIMNYIRSGIDSGATLETGGERLGERGYYIKPTVFSNVKDDMLIAQDEIFGPVQSILKFKDVDDVIRRANNSRYGLAAGVFTQNIDTANTLTRALRVGTVWVNCFDTFDATIPFGGYKMSGHGREKGEYSLKNYLQVKAVVTPLKNPAWL

SEQ ID NO: 6913 - protein, 185 aa, Zea mays
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTSKSSDGSIKKDALGHVGASSSAVQGMGQQGTYNQGMGYMQPQYHNGDISN

SEQ ID NO: 6914 - protein, 672 aa, GIBBERELLA ZEAE PH-1
MASGPLKAALLIVSTTAAKDASADASGPILTQVLKDEGEGKWEVYDTKIVTDDVLAIQRQITAWTDGSDSINLVVTTGGTGFATGDSTPEAVTPLLHKQAPGLVHGMLAASLTVTPFAMMSRPAAGVRNSTIIVTLPGSPKGAKENLQAIIKTLPHACIQAAGANSRAIHSGGVKKLEAEAGISSKNKQPPATGHGCGHHHHGHSHGSGHGHSHGNLVRHTKPGTTLSNDPALGPSRRYRESPYPMLPVKEALALIEQHTPGPEVVTASVDQSIVNSVLAEDVEAKENVPAFRASIVDGYAVVAPKDGQLKGVFPVTAISHAAPGEIGALKEGELARITTGAPLPPGATTVVMVEDTVLKTMSDDEKEEKEVEIQVEGVKEGENIREVGSDVKQGTVILNKGETISGVGGEIGLLASVGVSEAKVYRRPVVAVLSTGDEIVEYNRPGDLKLGEVRDTNRITLMSAAREWGYEVVDLGIASDKPGTLEETLRDGLRRADLLITTGGVSMGELDLLKPTIERSLGGTIHFGRVAMKPGKPTTFATVPVKDNAGQRVIKAIFSLPGNPASALVTFHLFVLPSLHKLSGASTVGLPRVPAVVSHDFPLDPRPEYHRAVVTVGKDGLLSATSTGGQRSSKVGNMRSANALVILPSGKGKLEKGSKVEVLLLNAVQAA

SEQ ID NO: 6915 - protein, 505 aa, Populus balsamifera subsp. trichocarpa X Populus deltoides
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 6916 - protein, 146 aa, Catharanthus roseus
RTLRELKLLRHMDHENVVAIRDIIPPPQRESFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 6917 - protein, 429 aa, Lactobacillus plantarum WCFS1 [sequence omitted]

SEQ ID NO: 6918 - protein, 108 aa, Zea mays
AWSRPRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 6919 - protein, 407 aa, Streptomyces avermitilis MA-4680
MAAEIVNPRSDSSTDQEGGAEPLDSFDPAFALHRGGKMAVQATVPIRDRDDLSLAYTPGVAKVCTAIAEQPELVHDYTWKSSVVAVVTDGTAVLGLGDIGPEASLPVMEGKAILFKQFGGVDAVPIALGTTDADEIVETVVRLAPSFGGVNLEDISAPRCFEIERKLQERLDIPVFHDDQHGTAVVTLAALRNAAKLTGRTLGELRAVISGAGAAGVAIAKFLLAAGLGDVAVADRKGVVSKDRDDLTPVKRELAEITNKAGLSGSLESALAGADVFIGVSGGTVPEPAVASMAEGAFVFAMANPNPEVHPEIAHKYASVVATGRSDFPNQINNVLAFPGIFAGALQVRASRITEGMKIAAADALADVVGDDLAADYVIPSPFDERVAPAVTAAVAAAARAEGVARR

SEQ ID NO: 6920 - protein, 447 aa, Zea mays
  unsure (1)..(447): unsure at all Xaa locations
MECVTDMPLATLDSRPRKRQRLGWDVVPAEMYQVTRPRLGWDVGPAEMNQFALCGQEVVNAFSAAVLGLSSGCVSSQVNQEQPHDGSPPLRXKMTRMGIMFLXVGDNLTSRYKINAKMGEGTFGQVLECWDKETKEMVAIKIIRGIKKYRDAAMIEIGMLEKLGKYGESRSSCVQIRNWFDYRNHICIVFERLGPSLYDFLRKNNYRSFPIALVREFAKQLLECIAFMHELRLIHTDLKPENILLVSPEYIKVPDYKVSSQSPKEGSYYKQLPKSSAIKVIDFGSTTYDQHDQSYVVSTRHYRAPEVILGHGWSYPCDIWSVGCILVELCTGEALFQTHENLEHLAMMERVLGPLPYHMLKRADRHSDKYIRKGRLNWPEGCTSRESMKAVMKLSRLQNLVMQNVDQAAGDFIGLLQGLLKYDPASRLTAREALRHPFFTEGFGRRR

SEQ ID NO: 6921 - protein, 108 aa, Zea mays
  unsure (1)..(108): unsure at all Xaa locations
RIPERVVHARGVSDKGFFECTHDVTSLTCAYLLLAPGVRTPVIVRFSTVIHERXVPWRHIRDPRGFVVKMYTREGNCDLLGNNFPGFLIRDGIKLRYVIHSNKPNPWS

SEQ ID NO: 6922 - protein, 168 aa, Zea mays
TEADACSDLYASRAVTLGPKLSDTVKGKLSLGAKILRAGGSVEKLFRQWFSADKDEKLLRASQCHLWTTAGPIAGVLFVSTARVAFRSDRSLSLAVSTPRGDCSFRAPYKVAVPLRKVGAVRPSENRHRPEQRYVRLATTDGFEFWFMGFVSYNKSLQHLERAVACAR

SEQ ID NO: 6923 - protein, 275 aa, Eremothecium gossypii
MSFMEDVSDVSESSNYDEWITSFCSRFGHEFFCQVPTEFIEDDFNLTGLSAEVPHYRRALDLILDLESLSEEDEDGVAASAGAASNGGDHSNGTSVRQAAHADGQPINKSIIDHCAEQLYGLIHARYILTKQGLQAMAEKFDHKEFGTCPRYYCGGMQLLPCGLSDTLGKNTVRLYCASCQDLYLPHSSRHLCLEGAFWGTSFPGVFLKHFKELEDYVEQKNKNVYRLRIFGFPVAKESISGPRMEWLRQYPSTEAEWQEFEKCEYEILKLEDQE

SEQ ID NO: 6924 - protein, 352 aa, Oryza sativa; identical to SEQ ID NO: 5344

SEQ ID NO: 6925 - protein, 449 aa, Zea mays
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILEVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 6926 - protein, 223 aa, Bradyrhizobium japonicum USDA 110
MMGRRHGYGTENLSPFDLSLAVMGTGLLWVGWFGFNGGSAGAANSRAVLAIIATHLAACSGALTWGAIEWSTRRKPSVLGMISGAVAGLGTITPASGFVAPWHGIVIGIIAGAVCYWACTWLKHRFDYDDSLDVFGVHGIGGLTGTLLAGVFATSAIGGTAGLLEGHPRQLLIQLYGVAVTFVWAAGVSFILLKLVGLFVPLRVSREHELEGLDISQHGEALQ

SEQ ID NO: 6927 - protein, 208 aa, Zea mays
  unsure (1)..(208): unsure at all Xaa locations
ERKCLIWCETHAGSAGTECTREILLGWDPKYEHDQTSCTGRPVIHTTLRCPHLKTXGTHPTHANPTTIGRFSPNGKXVTYGDASGCVRVXRRYGHRAXKAELSPLSRRVXDLRWTSDGLHIGDSGDGKGTAFGQEFVWDSATTAXEIDDHVRRVVLSXDVHPTPPLHIPTXNEDCLANYYEGPAFKDKHSLKDRSNFVNCIREAPEWQ

SEQ ID NO: 6928 - protein, 115 aa, Thermoplasma acidophilum
MDDDEELERIRRQQLESMQRQAMQEQMREEQEKQREAERARRQQILRQILDPSARERLNNVRLVRPDLADNVENQLIQLASMGRINRMLSERDIIDILSKLTENKREPKIERRSK

SEQ ID NO: 6929 - protein, 315 aa, Brachyspira murdochii
RIGRLVFQALVERGLLGKEIDVVGVVDVSTDAQYFAYQLKYDSVHGRMKADISHEGEDVLVVNGNKIKCIKAAPLNQLEQLPWKDLGVEFVIESTGLYTEKEKAEGHIKAGAKKVIISAPGKGDLRTFVYGVNHEEYDPANHHVVSNASCTTNCLAPLVHVLLKEGIGIETGLMTTIHSYTATQKTVDGPSKKDWRGGRAAAVNTIPSTTGAAKAVGEVLPSTKGKLTGMSFRVATPDVSVVDLTFRSEKETSIKEIDALMKKASETYMKGVLGYCDEELVSSDFIHDNRSSIYDSLATTQNNLKDEKRFFKIVS

SEQ ID NO: 6930 - protein, 225 aa, Solanum dulcamara
LSFQYSDEEGSSHIVEDYFQRTMGEKFSHLGKVYQDYCNAMSTLSLRIMELLGLSLGVSRNHFKEFFQENESIMRLNYYPTCQKPELTLGTGPHCDPTSLTILHQDSVGGLQVFVDNEWHSITPNFNAFVVNIGDTFMALSNGRYKSCLHRAVVNNKIPRKSLAFFLCPKKDKVVTPPIELVDSNNPRIYPDFTWPDLLEFTQKQYRADMNTLQTFSIWLQKTQV

SEQ ID NO: 6931 - protein, 502 aa, Capsicum annuum
MEIQFTNLVAFLLFLSSIILLLKKWKTQKLNLPPGPWKLPFIGSLHHLAVAGPLPHHGLKNLAKLYGPLMHLRLGEIPTVIISSPRMAKEVLKTHDLAFATRPKLVVADIVHYDSTDIAFSPYGEYWRQIRKICILELLSAKMVKFFSSIRQDELSMMVSSIRTMPNFPVNLTDKIFWFTSSVTCRSALGKICRDQDKLIIFMREIISLTGGFSIADFFPTWKMLHDVGGSKTRLLKAHRKIDEILEHVVNEHKQNRADGQKGNGEFGGEDLIDVLLRVRESGEVQISITDDNIKSILVDMFSAGSETSSTTIIWALAEMMKKPSVLAKAQAEVRQVLKEKKGFQQIDLDELKYLKLVIKETLRMHPPIPLLVPRECMKDTKIDGYNIPFKTRVIVNAWAIGRDPESWDDPESFSPERFENSSVDFLGSHHQFIPFGAGRRICPGMLFGLANVGQPLAQLLYHFDRKLPNGQSHENLDMTESPGISATRKDDLVLIATPYDP

SEQ ID NO: 6932 - protein, 375 aa, Saccharomyces bayanus
MLRTSTLFTRRVQPSLFARNILRLQSTIAIPQTQKGVIFYENNGKLHYKDIPVPEPKPNEILINVKYSGVCHTDLHAWHGDWPLPVKLPLVGGHEGAGVVVKLGSNVKGWKVGDLAGIKWLNGSCMTCEFCESGHESNCPDADLSGYTHDGSFQQFATADAIQAAKIQQGTDLAEVAPILCAGVTVYKALKEANLKAGDWVAISGAAGGLGSLAVQYATAMGYRVLGIDAGAEKEKLFKQLGGEVFIDFTKTKDMVSDIQEATKGGPQGVINVSVSEAAISLSTEYVRPTGTVVLVGLPANAYVKSEVFSHVIKSINIKGSYVGNRADTREALDFFSRGLIKSPIKIVGLSELPMVYDLMEKGKILGRYVVDTSK

SEQ ID NO: 6933 - protein, 331 aa, Geobacter metallireducens
MALRVAINGFGRIGRSVLRAAIKEKGIEFVAINDLTDAKTLAHLLKYDSVHGPFPGKVEAGNGEIIVNGKPIKILAVRNPEELPWKKEKIDVVLESTGLFTSREKAELHLKAGAKKIIISAPATNEDITIVMGVNSNLYDPKKHNIISNASCTTNCLAPVAKVLHETFGIEKGLVTTVHSYTNDQQILDLPHKDLRRARAAAMSMIPTSTGAAKAVALVLPELKGKLDGMAIRVPTPNVSVVDLVVTLSKKADADKVNAALKKASKGSLKGVLGFSEEPLVSIDFNGNPLSSIVDAGCTKVIEGNMVKVLSWYDNETGFSHRVVDLMKLIA

SEQ ID NO: 6934 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 6935 - protein, 334 aa, Chlorobium tepidum TLS
MAKVKVGINGFGRIGRLVFRQAMENPEIEIVGINDLTDVKTLAHLLKYDSSHKKFNGEVTIEGDNLIVNGRTIAICAQKDPAQLPWASLGATLVVESTGIFTSREAASKHLAAGAKKVIISAPAKDKIDATIVIGVNDKSITGKEEIISNASCTTNCLAPMTKVLNDNFGIVKGFMTTVHAYTNDQNILDLPHKDLRRARAAACSIIPTSTGAAKAIGEVLPELAGKLDGFAMRVPIPDGSVTDLSVIIEKSATKEEINAVMKAAAEGPMKGILEYNVDPIVSCDIVGNAHSCIFDSPLTMSSGNMVKIVGWYDNELGYATRVVDLLGIYSKFV

SEQ ID NO: 6936 - protein, 443 aa, Escherichia coli CFT073
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFEEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 6937 - protein, 490 aa, Cylindrotheca sp. (STRAIN N1)
MSQSVSERTRIKSDRYESGVIPYAKMGYWDASYAVKTTDVLALFRITPQPGVDPVEAAAAVAGESSTATWTVVWTDLLTACDRYRAKAYRVDPVPNAADQYFAFIAYECDLFEEGSLANLTASIIGNVFGFKAVAALRLEDMRIPHSYLKTFQGPATGIVVERERLNKYGTPLLGATVKPKLGLSGKNYGRVVYEGLKGGLDFLKDDENINSQPFMRWRERFLNCMEGINRASAATGEVKGSYLNVTAATMEEVYKRSEYAKEVGSIIIMIDLVMGYTAIQSMALWARENDMLLHLHRAGNSTYARQKNHGINFRVICKWMRMSGVDHIHAGTVVGKLEGDPLMIKGFYHTLRLTTLDVNLPYGLFFEMSWASLRRCMPVASGGIHCGQMHQLIHYLGDDVVLQFGGGTIGHPDGIQAGATANRVALESMVLARNEGADYFNQEVGPQILRNAAKTCGPLQSALDLWKDISFNYTSTDTADFAATSTANV

SEQ ID NO: 6938 - protein, 195 aa, Mitthyridium sp. Wall 2846
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTSDVSVVDLTVRLEKPASYDAIKAALKEASQGKMKGILGYTEDDVVSSDFITDSQSSIFDAKAGIALSDTFVK

SEQ ID NO: 6939 - protein, 335 aa, Leptospira interrogans serovar lai str. 56601
MTRIAINGFGRIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVSWYDNEMGYSNRVLDLIRYMAKKG

SEQ ID NO: 6940 - protein, 473 aa, Centroceras clavulatum
YESGVIPYAKMGYWDPEYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIVMIDLVIGYTAIQTMGVWARKNDMILHLHRAGNSTYSRQKIHGMNFRVICKWMRMAGVDHIHAGTVVGKLEGDPLMIRGFYNTLLLTHLDINLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 6941 - protein, 94 aa, Oryza sativa (japonica cultivar-group)
MKTRRAALLMLLLLVVVAAASWPQPCDAASGFCGSKCAVRCGRGRGRGSGCLRSCGLCCEECNCVPTGSGSTRDECPCYRDMLTAGPRKRPKCP

SEQ ID NO: 6942 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 6943 - protein, 237 aa, Methanococcus vannielii
DPDMIFEIKDAVSIPVMAKARIGHFVEAQVLESIGVDMIDESEVLTPADEINHINKKAFTAPFVCGARNLGEALRRIDEGAAMIRTKGEAGTGNVVEAVKHMRAVNEGIARVVGYHEMGLEAELVQMARNELKVPMEIILEVAKLKRLPVVNFAAGGIATPADAALMMQMGCDGVFVGSGIFKSGNPEIRAKAIVEATYNFDKPELIGEVSKNLGEAMVGINIDQIPEEMLLAKRGI

SEQ ID NO: 6944 - protein, 214 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMGHNGIEYGDMQLIAEAYDVFKSVWKLT

SEQ ID NO: 6945 - protein, 810 aa, Oryza sativa
YYPYYLSDNTKNVLLSCAFIHLEKKEFIKQFSEISSINQRILLSGPAGSEIYQETLIKALAKHFGARLLVVDSLLLPGAPSKDPESQKDAAKSDKSGDKAGSEKLAILHKNRSSLADAMHFRRPAVQPSSVHADIVGTSTLHSASLPKQESSTATSKSYTFREGDRVRYVGPAQQSSLSQRGPSYGYRGRVMLAFEENGSSKIGVRFDKQIPDGNDLGGLCEEDHGFFCSADLLRPDFSGGEEVERLAMAELIEVISEEHKAGPMIVLLKDVEKSFTGITESLSSLRNKLEALPSGVLIIGSHTQMDSRKEKAHPGGFLFTKFASSSQTLFDLFPDSFGSRLHERNKESPKAMKHLNKLFPNKISIQLPQDETLLTDWKQQLDRDVETLKAKSNVGSIRTFLSRNGIECSDLEELFIKDQSLTNENVDKIVGYAVSYHLKHNKVEISKDGKLVLASESLKHGLNMLQNMQSDNKSSKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRRFPRRLMVNLPDASNREKILKVILAKEELAPGIDMDSLATMTDGYSGSDLKNLCVTAAHYPIREILEKEKKEKNVAKAEGRPEPALYGSEDIRPLTLDDFKSAHEQVCASVSSDSANMNELLQWNDLYGEGGSRKKKALSYFM

SEQ ID NO: 6946 - protein, 157 aa, Glycine max
  unsure (1)..(157): unsure at all Xaa locations
GIRHEAGAGMVAPFTGLKSMAGFPTRKTNNDITSIASNGGRVQCMQVWPPVGKKKFETLSYLPDLDDAQLAKEVEYLLRKGWIPCLEFHLEHGFVFREHNRSPXYYHGRYWTMWKLPMCGRTVASQVVKELKEDKTECXSGFIRVIGCTTAPSAVFE

SEQ ID NO: 6947 - protein, 362 aa, Oryza sativa
MALRRLLQGSVLPRMAGRAAAAPFSTASGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKTNGRERVSAIHKANIMRKTDGLFLKCCREVAEKYPEIVYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNNQADRIHNAILQTISEGKFRTADLGGKASTSDFTKAVCDHI

SEQ ID NO: 6948 - protein, 285 aa, Zea mays
  unsure (1)..(285): unsure at all Xaa locations
MATAATAAAALTGATTATPKSRRRAHHLATRRALAAPIRCSALSRATPTAPPATPLRPWGPNEPRKGSDILVEALERCGVRDVFAYPGGASMEIHQALTRSPVIANHLFRHEQGEAFAASGYAXRSSGRVGVCIATSGPGATNLVSALADALLDSVPIVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEE

SEQ ID NO: 6949 - protein, 574 aa, Buchnera aphidicola (Schlechtendalia chinensis)
MEMLSGSEMIIQSLIDQGIKYIFGYPGGAVLDIYDSLKSTKKIKHILVRHEQGATHMADGYARATGKIGVVLVTSGPGATNSITGIATAYMDSIPIVVISGQVSSSLIGYDAFQECDMIGISRPIVKHSFLVKKTEDIPITFKKAFWLASSGRPGPIVIDLPKDILNSYNKKPYIWPIEVNIRSYNPITKGHSRQIKKAIDILKLSKQPVIYAGGGVISANCHNELKELAEKLNIPVTTSLMALGAFPGNHPQNLQMLGMHGTYEANMAMHYADVILAIGVRFDDRTTNNVKKYCPNATIIHIDIDPTSISKTITAHIPIVGNAKNVLQQILVFINSNMFVKEFYCLKKWWIKIQSWKNKNSLNFDTNSDNIKPQSVIKTIWKLTKGKAFITSDVGQHQMFAALYYSFQKPRRWINSGGLGTMGFGLPAALGVKLAFPNETVICVTGDGSIQMNIQELSTAMQYELPILILNLNNKSLGMVKQWQDIIYSGRHSHSYMKSLPNFIKLAESYGHSGISINTPKELEKKLQLALEKLQNGHLVFVDIKIDASEHVYPMQIRDGGMNNMLLRKNGQK

SEQ ID NO: 6950 - protein, 510 aa, Triticum aestivum
MFIESFKVESPNVKYTENEIHSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPAGTPVVNALSKQRAMLENILRACVGLAPENNMILEYK

SEQ ID NO: 6951 - protein, 228 aa, Zea mays
MLFLHCQSCIPSHPRPRRPTPPFRPRVSVAAPLSVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 6952 - protein, 457 aa, Zonaria diesingiana
DYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVIVERERLDKFGRPLLGATVKPKLGLSGKNYGRVVYEGLRGGLDFLKDDENINSQPFMRWKERFLYCMEGVNRSAAATGEVKGSYLNVTAATIEQMYERAEYAYSLGTVIVMIDLVIGYTAIQTMAIWARKAQMILHLHRAGNSTYARQKNHGINFRVICKWMRMAGVDHIHAGTVVGKLEGDPLMVRGFYNTLLLTHLKVNLAEGLFFDMDWASLRKCVPVASGGIHCGQMHQLLYYLGDDVVLQFGGGTIGHPDGIQSGATANRVALEAMVLARNEGRDYVSEGPEILRTAAATCAPLKTALDLWKDITFEYTSTDTPDFVEVATGSN

SEQ ID NO: 6953 - protein, 339 aa, Glycine max
MDHSADAHRTDLMTITRFVLNEQSKHPESRGDFTILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 6954 - protein, 338 aa, Lactobacillus gasseri
MTVKIGINGFGRIGRLAFRRIMDLGEKSSDIEVVAINDLTTPALLAHLLKYDSTHGTFNHEVSATDDSIVVDGKKYRVYAEPQAQNIPWVKNDGVDFVLECTGFYTSKAKSEAHLKAGAKRVLISAPAGSDLKTIVYGVNDDTLTADDKIVSAGSCTTNSLAPMVNALQKEFGIEVGTMTTIHAYTSTQMLLDGPVRGGNLRSARAAAINIIPHSTGAAKAIGLVVPELNGKLNGHAQRVPVPDGSVTELVSILSKDVTADEVNEAVKKYESPSFAYNDHNIVSSDVLGMTAGSIFDPTQTMVTTAGDKQLVKTVAWYDNEYSFTCQMVRTLLKFATL

SEQ ID NO: 6955 - protein, 702 aa, Bacillus clarkii
VFRKLLCTLVTIITLSAWIVSHGGEVHASNATNDLSNVNYAEEVIYHIVTDRFKDGDPDNNPQGQLFSNGCSDLTKYCGGDWQGIIDEIESGYLPDMGITALWISPPVENVFDLHPEGFSSYHGYWARDFKKTNPFFGDFDDFSRLIETAHAHDIKVVIDFVPNHTSPVDIEDGALYDNGTLLGHYSTDANNYFYNYGGSDFSDYENSIYRNLYDLASLNQQHSFIDKYLKESIQLWLDTGIDGIRVDAVAHMPLGWQKAFISSVYDYNPVFTFGEWFTGAQGSNHYHHFVNNSGMSALDFRYAQVAQDVLRNQKGTMHDIYDMLASTQLDYERPQDQVTFIDNHDIDRFTVEGRDTRTTDIGLAFLLTSRGVPAIYYGTENYMTGKGDPGNRKMMESFDQTTTAYQVIQKLAPLRQENKAVVYGSTKERWINDDVLIYERSFNGDYLLVAINKNVNQAYTISGLLTEMPAQVYHDVLDSLLDGQSLAVKENGTVDSFLLGPGEVSVWQHISESGSAPVIGQVGPPMGKPGDAVKISGSGFGSEPGTVYFRDTKIDVLTWDDETIVITLPETLGGKAQISVTNSDGVTSNGYDFQLLTGKQESVRFVVDNAHTNYGENVYLVGNVPELGNWNPADAIGPMFNQVVYSYPTWYYDVSVPADTALEFKFIIVDGNGNVTWESGGNHNYRVTSGSTDTVRVSFRR

SEQ ID NO: 6956 - protein, 505 aa, Cicer arietinum
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKASTLTSTLTARSKVASGVKTKTKEQIVDIDAADVTNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASHQVYAARCTLNKAPFWNETLQLHTGFSEPQLMDCAKLLVAFHKMAGDQKLKSIYRKYSNLERGAVALLSPAKSLFVFLIELLMNAIEKMQCSLFFTSEIWCRFLTCFGRNISPGCSLVLLQRNFLIPLILYAL

SEQ ID NO: 6957 - protein, 440 aa, Glycine max
MASRLEQQQQPTNVGGENKQKNMGGEGRNRRVLQDIGNLVGKQGHGNGINVSKPVTRNFRAQLLANAQAATEKNKKSSTEVNNGAVVATDGVGVGNFVPARKVGAAKKPKEEPEVIVIISDDESDEKQAVKGKKAREKSAMKNAKAFSSVLSARSKAACGLPRDFVMNIDATDMDNELAAAEYIDDIYKFYKETEEDGCVHDYMGSQPDINAKMRSILVDWLIEVHRKFELMPETLYLTLNIVDRFLSVKAVPRRELQLVGISSMLIASKYEEIWAPEVNDFVCISDNGYVSEQVLMMEKQILRKLEWTLTVPTPYHFLVRDTKASTPSDKEMENMVFFLAELGLMHYPTVILYRPSLIAASAVFAARCTLGRSPFWTNTLMHYTGYSEEQLRDCAKIMANLHAAAAPGSKLRAVYKKFSNSDLSAVALLSPAKDLSALS

SEQ ID NO: 6958 - protein, 211 aa, Triticum aestivum
  unsure (1)..(211): unsure at all Xaa locations
MAPTVMASSATSVAPFQGLKSTAGLPVSRRSNGASLGSVSNGGRIRCMQVWPIEGIKKSETLSYLPPLXTEALLXKQVDYLXIRSKWVPCLEFSKVGFIFXREHNASPGYYDGRYWXTMWKLPMSGCTDATQVVNEVEEXKKEYPDPYSAHRVHNIASASSAHRLNQPAARSGRLNTHHDSILNANLQMLGFHYFYCPKRFLGLSMAKQPL

SEQ ID NO: 6959 - protein, 368 aa, Leuconostoc mesenteroides subsp. mesenteroides ATCC 8293
MNALIGEEIRKMKKTVKALAAYQAELPVETVKAKYGLQHLARLSANESVYGPSPKVAQAVRAVSDDILGYYPDGQATELREAVAKLNHVDPQHLVFGAGADELIELLTRVVLEPGSNIIIPNPTFGEYAMHAQIEQSTTKKIPVNVDNGNVDFDAILDAIDDKTAMVWIANPNNPTGVFETTSSIKRFLDKLPANITLVVDEAYYDFVDEPDATVAPLVAEYTNLVVLRTLSKAYGLANLRVGYGIMQDPLYSAMQAVRLPYNLSTYQIAGGTAAVLDQEYLQKNVQRFQVERQKFQDFLTKNKFKFYESQANFIWIKVGETKKVGQKLLEQGFQVNDRLNPEWIRIALGTPEDNAELKLAFLKATNK

SEQ ID NO: 6960 - protein, 439 aa, Oryza sativa (japonica cultivar-group)
MSPSPPPPHRGGLFSSTPLRSNGSPSPAAWWSSSREEMAREGSPVDGVVQPQQQPSPTTASGQQSQQQKVTLITLPPPREVARPEMPKDSTPSAGRVDEEEWVTVFGFLPGDTNLVLREFEKCGIVLRHVPGPRDANWMHILYQSRHDAQKALTKHGQQLNSVLIIGVKQVDPWQRQYLNEKTNENFQVGATDPFPSQHVAPSSFTTRNALAPLPSNSMPNGIGNGSGRGASGAIASPTKSVLSKVMDLIICIVPSLRSSGCHTGISPGRSGASVDGVSLIKSDCLVKRKKNILDLCLKLHQYCRVAMRSVRIHASYVYSRPESRRITSMCHHFLAVDEHCHRNNPLLSLNQFLPLDQTYTLLSDCEVRAIFSSKPDVAVVLPIRFREEIKDEPHAATHIITPILIKAKWPCALSVLNQAKLRLITPHVRHPGRQLIII

SEQ ID NO: 6961 - protein, 537 aa, Neurospora crassa
MTLLALKEDRPTPKAVYNWRVYTCAAIASFASCMIGYDSAFIGTTLALPSFTKEFDFASYTPGALALLQSNIVSVYQAGAFFGCLFAYATSYFLGRRKSLIAFSVVFIIGAAIMLAADGQGRGIDPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLYANGKREEAMKVLCWIRNLEPTDRYIVQEVSFIDADLERYTRQVGNGFWKPFLSLKQRKVQWRFFLGGMLFFWQNGSGINAINYYSPTVFRSIGITGTDTGFLTTGIFGVVKMVLTIIWLLWLVDLVGRRRILFIGAAGGSLCMWFIGAYIKIADPGSNKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFLPETKSIPLEAMDRLFEIKPVQNANKNLMAELNFDRNPEREESSSLDDKDRVTQTENAV

SEQ ID NO: 6962 - protein, 499 aa, Nicotiana tabacum
MGKLVVGVSVVCTAAVVCGVAVLLMKRRMKNSGEWGKVEALLKDFEEKCATPMGKLKQVADAMTVEMHAGLASEGGSKLKMLISYVDNLPTGDEEGLFYALDLGGTNFRVMRVQLGGNEKRIVKHEVKEVSIPQNVMAGSSSEVLFDFIATALAEFVATEGDDFHLPPGRQRELGFTFSFPVKQLSIASGTLIKWTKGFSIEDVVGQDVVGELAKAMERAGLDVRVTALVNDTVGTLAGGRYNDPDVIAAVILGTGTNAAYVERAHAIPKWHGLLPKSGEMVINMEWGNFLSSHLPVTEYDQNLDVESLNPGEQIYEKMISGMYLGEILRRVLCRMAKEASLFGDYVPSKLKIPFILRTPDMAAMHHDESADLKVVGNKLKDILEVPNSTLKMRKIVVELCDIITSRGARLSAAGIVGILKKLGKDTLKDGENQRSVIAVDGALFERYTKFRNCLEETMKELLGDTADSIVIELSNDGSGVGAALLAASPSQYTDLEES

SEQ ID NO: 6963 - protein, 573 aa, Trichoderma harzianum
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 6964 - protein, 200 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGK

SEQ ID NO: 6965 - protein, 454 aa, Porphyra brumalis
  unsure (1)..(454): unsure at all Xaa locations
IKETDILXLFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 6966 - protein, 436 aa, Zea mays
MPPSLFTPRFRFSSAPVPEPLLGLIDLGASRDLSGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 6967 - protein, 467 aa, Mycobacterium tuberculosis CDC1551
MQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 6968 - protein, 469 aa, Oryza sativa
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEQEPDVTNSQKAPTQTPKAPTHPTFATSVKKSIGAKKIGGKTGGLGVKKLTTKPSESLYDQKPEEPKPAAPVMTTSTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAGSSSISSADLFGRRDMDDSNLDLSAADLINRISFQASQDLSSLKNMAGETGKKLTSIASNFISDLDSRDMPPPKRAKRAEPSSDEERYSSDDESYSSDSDDSDDASEEVSAYLYLGSSLSGVPTHRLMRVALRIV

SEQ ID NO: 6969 - protein, 262 aa, Corynebacterium efficiens YS-314
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 6970 - protein, 113 aa, Enterobacter gergoviae
SDFAGGTVVHINAAVAGLVGAYMMGKRVGFGKEAFKPHNLPMVFTGTAILYVGWFGFNAGSASAANEIAALAFVNTVVATAAAILAWTFGEWALRGKPSLLGACSGAIAGLVA

SEQ ID NO: 6971 - protein, 488 aa, Vaucheria cornonata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPFLGATVKPKLGLSGKNYGRVVYEGLRGGLDFLKDDENINSQPFMRWRERFLYCMEGVNRAAAATGEIKGSYLNATAGTIEEMYERAEYAKKLGTIIVMIDLVIGYTAIQSMAIWARKADMILHLHRAGNSTYARQKNHGINFRVICKWMRMAGVDHIHAGTVVGKLEGDPLMVKGFYNTLLETKLEINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATQSK

SEQ ID NO: 6972 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 6973 - protein, 523 aa, GIBBERELLA ZEAE PH-1
MSNVHDYVPSATEKAEKETPTPDNASYHVVHQTGTVHELGNIVDPVLSAKTLLVNEAINEIGWTNFHLKLSCLAGFGYAADSLVVFLQSVAASQAYLEIGDGGYPTGYAMALYAGLLVGALFWGFGADVIGRKIAFNVTLFIAAIATIAAGAGPNWIGFCVLVAILGFGAGGNLVLDPTVMLEFVPARQQWVITAMAAWWGIGQASAGFIAWGFYSRPEWSCTSETESCTWQSNKAWRLIMFTGGALMFLMSALRILIIQLPETPKFLVASGKEEELVAMLQKLASKYRRPCSLTVEALRACGTTNASEQSGRPDSFKGLGKSLFGHIRGLFSNKKLAISTILIWFSWTLIGLGYPLFFLYLPSRLPDYVPSFTQTWRDYTITNICAIFGPLIAAGLTEVKFLGRRYTMVVGAIVTAIFFFCYTIIKTPAQNLAISSCISVCINLYYGTLYAYTVEVFPSAHRSTGNGVAVALNRIMGLLSAVISVTADTTTVTPLYISAGLFIVLAIISVILPFEPYGHNAS

SEQ ID NO: 6974 - protein, 224 aa, Zea mays
HASAHASAHASAGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 6975 - protein, 341 aa, Zea mays
  unsure (1)..(341): unsure at all Xaa locations
MLHLHCCSMESSQGFGNLAAGVVGMVVSRAFTSSVPSNADFVWRIVLMFGAVPATLSYYWRMXMPETARYTALVAKDAKKVASDMSAVLNMHIVPEDEAVFELVRHDQYGLFSAEFLRRHGAHLLGTSMCWLAVDITFYSLNLYMKDIFVDVGLIDPPGKNHLFMRMTVTTLLHTGIALCGTLPGYFFTVAFVDRIGRVRIQLLGFTMMSVLTAILAATYAYWKRQETIQRKMGFAVLYGLTNFFANFGPNTTTFIVPAEIFPARMRATCHGIAGAFGKIGAIIGVFGFMSNMEEHGVVPRKLWALFSSNLVGLVFTFLLPDSKGKSLEEMAGETEEQQQP

SEQ ID NO: 6976 - protein, 309 aa, Coxiella burnetii RSA 493
MSQSHQRTAIIGECLIELTPKNGKDFSLNFAGDTLNTAVYLVRSLSKTTMVTVDYVTALGADTFSHEMLNQWLGEGIGVSLVRQIPDKLPGLYLIRNDEKGERYFYYYRSQSAARALFEREEGDRLCQKLLEFDNLYLSGITLAMLYETGCDKLLDCLKVAHKKGKTICFDTNFRAHLWPNLDSARAIIEEILKLTTIGLPSFSDEKTLFGDKSPKETAERFHRYGVKEVVVKQGENGYWLSDETGEKQVAIERATKVIDTTGAGDAFNGAYLAARFEGLNSETASQKAAHLAATVVAYRGAIIPITRQ

SEQ ID NO: 6977 - protein, 427 aa, Psilosiphon scoparum
IEASAAVAGESSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAGTGEIKGHYLNVTAGTMEDMYERAEFAKQLGSVICMIDLVIGYTAIQTMAVWARKTDMILHLHRAGNSTYSRQKIHGMNFRVICKWMRMAGVDHIHAGTVVGKLEGDPLMIKGFYNTLLLSHLDVNLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKNISFNYTSTDTADFV

SEQ ID NO: 6978 - protein, 539 aa, Zea mays; identical to SEQ ID NO: 1534

SEQ ID NO: 6979 - protein, 583 aa, Neurospora crassa
MGGGGGSGAAGFYDAALQRREAVMGKSGPAALVKNFRVFSIACFACIGGVLYGYNQGMFSGVLAMPAFQKHMGEYDPIDENASQTKKGWLTAILELGAWLGTLLSGFMAEVLSRKYGVLVACLVFMLGVVIQATSISGGHETILAGRFITGMGVGSLAMIIPIYNSEVAPPEVRGALVALQQLAICFGIMVSFWIDYGTNYIGGTKLETQSDAAWLVPVCLQLAPALILFFGMMFMPFSPRWLIHHGREAEARKILSTLRGLPQDHELVELEFLEIKAQSLFEKRSIAELFPELREQTAWNTFKLQFVAIEKLFRTKAMFRRVIVATVTMFFQQWSGINAILYYAPQIFKQLGLSGNTTSLLATGVVGIVMFIATVPAVLWIDRVGRKPVLTIGALGMATCHIIIAVIVAKNVDQWETHKAAGWAAVAMVWLFVIHFGYSWGPCAWIIVAEIWPLSTRPYGVSLGASSNWMNNFIVGQVTPDMLKAIPYGTYIIFGLLTYMGAAFIWFFVPETKRLTLEEMDMIFGSEGTAQADNERMEEINAEIGLTRFLQGGSGANQGAADGSDTGYDAEKGKSEHYSQHV

SEQ ID NO: 6980 - protein, 332 aa, Clostridium perfringens str. 13
MSSTLAVTVVIILLTLAFDFINGFHDTATAVATSISTRALSPKAAIALCAVFNFVGAFLGTEVAKTVGDGIVDQNKIPLWVIAAVILGAIIWNLITWYFGIPSSSSHALIGSLIGGGIAYSHSINIVSWGTLFDEVILWLILSPIIGLIVGYIFMILLNWALRRCKPGPVNRIFSKLQVVSGALMALNHGGNDAQKSMGIITMALLSGGFLSTFEVPTWVIALCAIAMATGTSIGGQKIIKTMGSGVAKLNAVNGFAAQTGAAGVIGIATMFHAPVSTTHIITTTIMGVGASKNPKAVKWGVAKNIVWAWILTIPISACIAAIVVEIFKFVL

SEQ ID NO: 6981 - protein, 138 aa, Zea mays
FTNIFTLCSCTLNDLINTEKTATICRSTNLDSWTPEQLKMMVYGGNNRAQAFFKQHGWTDGGKIEAKYTSRAADLYRQLLAKDVAKSSTEDGNNSWPSSPVAASQAPNQAAAFPDLKLTEVSKENVSEKKDSEIVRSP

SEQ ID NO: 6982 - protein, 256 aa, Zea mays
RSVKLAPPPSASSSSSGGVASSPASSACRCRRRNELVVVEAPDTPPCRRDIFAGYSSDGDDECVKKPTVAVRAHHRLDGKVITSATDIIFDLRTKKRPGKSLPPIATKPAARREPDVCQLEDKHIDVLTHAARRTSPAVPEQSTLKPRRSVSSARRLKTRANTPRLASSKKCKSPTAARSKPPPLAKSFAVVKSSRDPRRDFRESMEEMIAENGIRAAADLEDLLACYLSLNAAEYHDLIVEVFEHIWVTLSDVKV

SEQ ID NO: 6983 - protein, 311 aa, Vibrio cholerae
MKVAVIGAAGGIGQALALLLKNRLPAGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEELLDIGKLSAYEQAALDGMLDTLKGDIQIGVEFVK

SEQ ID NO: 6984 - protein, 76 aa, Zea mays
TRPGIYGYPRDKKSKNGKLRLLYECAPMSFIVEQAGGKGSDGHQRILDITPTEIHQRVPLYIGSVEEVDKVEKFLA

SEQ ID NO: 6985 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 6986 - protein, 333 aa, Geobacter metallireducens
MLDATLIMLVLVIGAALAFDYINGFHDTANAIATCVSTRALSVRAAIIMAAVLNFAGAMISTKVAATIGKGIVDAPNVTQMVVLAGILGAIVWDLITWYYGLPASSSHAIIGGLMGAVIAHAGTTALHWKGLEKIVLSLVLSPIVGTFLGFAVMVIMLWCFKSTSPYSINKHFRRLQVLSAAFMAFSHGTADAQKSMGVITMALVSYGALSSFVVPTWVKIACAVAMGLGTAAGGWRIIKTVGKDFVKLQPVHGFCVETASAGVILGASSIGMPVSTTHVITSAILGVGLSKRLTAVNWNVAGRIVVAWVLTIPASAIMAYVCYQVLNPILGK

SEQ ID NO: 6987 - protein, 307 aa, Glycine max
MGSPGSGRFAGAIPWTSLLNHKKKRNATKSNLDLPLSRPPVVPNPIRSPPSSVAMGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 6988 - protein, 138 aa, Oryza sativa
  unsure (1)..(138): unsure at all Xaa locations
MRTPIHKARTMQDLDQMKRRLKDMEVEANALRQMLPTVVLDMKSLHPNASSCESXEEMNARSVYVENVYYTCTLXELQMHLNTCGTTHGMTILTHKFVQPESCHYHEFLGVXADHEAVKYNESXLDGRQIMVAPKRTN

SEQ ID NO: 6989 - protein, 248 aa, Oryza sativa
VLGQSTMFGSCLNYATLKLLGEALHNNDALAQGRMWILSHGSATAAPQWAKIWLSVIGVYDWSGNKAIIPELWMVPHFLPIHPARFWCFVRMIYMSMAYLYGKKFVGPITPTILEIREELYNIPYSEIDWKKARDCCAKEDLRYPCSWIQDIVWTYLNKYVDPMFNVWPFNKLREISLRNLMKHIYYEDENTKYIGLCPINKALNMICCWIEDPNSDAFKRHLPRIYDFLWLAEDGMKAQIVNICRLP

SEQ ID NO: 6990 - protein, 420 aa, Xanthomonas campestris pv. campestris str. ATCC 33913
MPDVVQADRCRAPSVGSGRGRVIPDRQTVAKPLALRPLRPTPPELPVSLPVSRRSFLSLATSGLAVSALGLTPAAEAARKRAAAPAAPSVALAAGTVYLNFNEHPTGLSPAALDAASRSLARSGRYLFEMEQDLRNLMAGELQLPHDHLAFFPGSSDPLNRAGTLFTSPRAGLVMADPTFEALADLAAAQGVPVRKVPLRADGAHDVKAMAKADPSAGLIYLCNPNNPTGSITPRAEIEWLLANKPASAVLVVDEAYIHYSTEPSVADLVRQRQDLIVLRTFSKLYGMAGMRLGAALAPPGLLTKLASLGGNPLPVPAMAAGIASLRDPMLVPSRRADNARVRDDTIAWLKSKGYTCLPSQANCFMVDVKRDGKVFADSMQKQGVIVGRSWPIWPKRVRVTVGSEAEMLRFREAFAKAKR

SEQ ID NO: 6991 - protein, 300 aa, Clostridium tetani E88
MMKGDIIMKVKKAVIPAAGLGTRFLPATKAQPKEMLPIVDKPTIQHIIEEAVASGIEEILIITGRNKRAIEDHFDKSVELEQQLKDTGKKDMLEMVEDISNMAEIYYIRQKEPKGLGHAINCARTFVGNEPFAVMLGDDVVYGDKPCLKQLIECYNEYKTTILGVQQVVREDVYKYGIVEGKHIENNVYKVKDLIEKPDVDEAPSNIAILGRYIITPKIFEILSTIEPGKGGEIQLTDALKKLSLQEAIYAYDFEGRRYDVGDKLGFLEATIEFALRKDEIKNDFEKYILGIAEQIQSEE

SEQ ID NO: 6992 - protein, 407 aa, Oryza sativa
MALSISTPPTSSSLLPASLQVRPPAPPPPPLSDELSFARFGRSSRPFHPFLVTAAASSSSGRQVELVGGDVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALAKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 6993 - protein, 195 aa, Buchnera aphidicola
MADILLLDNLDSFTYNLVEQLRNKNNNVLIYRNNIDIKIILNSINKIKNPILTLSPGPSTPKNAGCMLNLINEVKGKIPIVGICLGHQAIVEAYGGIIGYAGEIFHGRASLINHDGLEMFEGLPQPLPVARYHSLICNKIPKNFIINSYFNDMIMSVRNNLDYVCGFQFHPESILTTSGALLLEKIIDWASSKYK

SEQ ID NO: 6994 - protein, 64 aa, Triticum aestivum
QVDLDNIDEKEHPKTAALEFMDCILEEGDLLYIPPKWWHYVRSLSISFSVSFWWRTSDLPSGSS

SEQ ID NO: 6995 - protein, 227 aa, Oryza sativa
RRLRGVTAAPRRAAAALPLTTSVRGVSDSTEPLTIETSVPYKSHIVDPPPREVATTARELATFFRDMSAMRRAEIAADSLYKAKLIRGFCHLYDGQEAVAVGMEAATTRADAIITAYRDHCAYLARGGDLAALFAELMGRRGGCSRGKGGSMHLYKKDANFYGGHGIVGAQVPLGCGLAFAQRYRKEAAVTFDLYGDGAANQGQLFEALNMAALWKLPVVLVCENNH

SEQ ID NO: 6996 - protein, 368 aa, Burkholderia fungorum
MKTYRIATIPGDGIGKEVVPAGRRVLEAIAARSDAFGFEFENFDWGGDYYREHGVMMPADGLDAIRHQDAILFGSAGDPHIPDHVTLWGLRLKICQGFDQYANVRPTRILPGIDAPLKRCGPQDLDWVIVRENSEGEYAGVGGRVHQGHPIEVATDVSMMTRAGVERILRFAFRLAQSRPRKLLTVITKSNAQRHAMVMWDEIAVQVSKEFPDVRWDKELVDAATARMVNRPATLDTIVATNLHADILSDLAAALAGSLGIAPTANLDPERRYPSMFEPIHGSAFDIMGKGLANPVGTFWSVVMMLDHLGEHAAARQLMAAIERVTADPSLHTGDLGGTATTAQVTDAVCAILAAGSPAVPAASVKAA

SEQ ID NO: 6997 - protein, 323 aa, Chlamydomonas reinhardtii
VQEGKSAEVPIYDFAKHSRSEETHTTGPADVIVVEGILVLAMQEVREMCNMKIFVDTDDDLRLARRIQRDVAHRGRDVASVLKQYTEHVKPMFDMYVAPSRRHADVIIPWGNRDNNLVAIDLIVEHIRTKLQQPDLCRVFPNFQIIPSNFQIQGMHTIIRDRETSKEDFVFYADRLNRLVVEAGLGFLPFTERSVITPTGNAYSGVGFARKLCGVSIIRSGEAMEAALRACCKGIKLGKILVHRHRDSSDVIYEKLPSDIADRHVMLLDPLLTTGGTAVKAIQILKDRGVPEDRILFLTIIAAPEGVHRVCSSFPGVKLLTSE

SEQ ID NO: 6998 - protein, 303 aa, Oryza sativa (japonica cultivar-group)
ENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQARLRRSLVRLLSTLVPSSAHPWSPTKLDVVPGTCDLLYREALVWNRMPIYVMGHGANTNNLLTFHRMPIYVMGIWGQGPIPGDAVQMPYLFELEVFPSGQRRATTSL

SEQ ID NO: 6999 - protein, 99 aa, Zea mays; identical to SEQ ID NO: 3237

SEQ ID NO: 7000 - protein, 512 aa, Debaryomyces occidentalis
MRFSTEGFTSKVVAAILAFSPLVSAQPIIFDKRDVGSSADKWKDQSIYQICTDRFARSDGSTTADCLVSDRKYCGGSYKGIIDKLDYIQGMGFTAIWISPVVEQIPDNTAYGYAYHGYWMKNIDLLNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQSYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNDVSAGDFGSLSVSISGGMPQVYAPSSVLSGSGICNQ

SEQ ID NO: 7001 - protein, 447 aa, Oryza sativa
  unsure (1)..(447): unsure at all Xaa locations
MPEKAVDDVMDSAAAAAAAAHSNGAVYANGVAADAAELVSPSALRQPFVIGTSVCEDFSWIFQGVSGGTASGKTTVCDMIIQQLHDHRVVLVNQDSFYRGLTAEESAHAQDYNFDHPDAFDTEQLLECMGQLKRAQPVNVPIYDFKNHRRSSESFRKVNASDVIILEGILVFHDQRVRNLMDMKIFVDTDADIRLARRIRRDTVERGRDVSSVLEQYGRFVKPAFDDFVLPSKKYADVIIPRGGDNHVAIDLIVQHIRTKLGQHDLCKIYPHVYVVQTTFQNINSCMYNLFLLGLGSIYMGVEFCKKLCGVSIVRSGESMENALRACCKGIKIGKILIHRVGDNGQQLIYHKLPMDIAERHVLLLDPVLGTXNSXNQAIELLIRKGVPEERIIFLNLISAPEGIQCVCKRFPRLKIVTSEIDTGLSEEYRVIPGLGEYGDRYFGTDN

SEQ ID NO: 7002 - protein, 479 aa, Desulfovibrio vulgaris subsp. vulgaris (strain Hildenborough)
MESSAPMSPRPEHATHSARESFSRLMREERLPGELIDLFLGYHGEIEASHTGLIGENDILPAKVEDFTHLDSLTRYAPEGRKLMHRAVCIRLNGGLGTSMGMTHAKSLLPARHDRSFLDIIHGQAEHQRKAHGGASPLLFMNSYATHADTLRALESMAAPEHMPRCFLQHRFPKVDRATLLPVRSHEAGDMAWNPPGHGDIYAALVLSGMLDALLSEGRRWALVANADNLGASLDPAILGYMAAHRIPFLMECARRTPADSKGGHLARTPEGGLVLREVAQCPADDMAHFQDIHRYGLFNTNNIWLDLAALRDRVERYGLLRLPLILNPKTLDPRDPESTPVWQVETAMGAAIALFPGATAIVTPRRRFLPVKRCNDLLLLWSDCFSLGEDFHLNRRVAHDSPLPRIDLDPKHYGTWDRLMQRFPHGAPAMRSCTAMQVRGDVRFGDDVALDGEVRIRNSAKAQAVIPDGTRLSGEVHL

SEQ ID NO: 7003 - protein, 495 aa, Escherichia coli O157:H7 EDL933
MNFHHLAYWQDKALSLAIENRLFINGEYTAAAENETFETVDPVTQAPLANIARGKSVDIDRAVSAARGVFERGDWSLSSPAKRKAVLNKLADLIEANAEELALLETLDTGKPIRHSLRDDIPGAARAIRWYAEAIDKVYGEVATTSSHELAMIVREPVGVIAAIVPWNFPLLLTCWKLGPALAAGNSVVLKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIQEGESKGQLLLDGRNAGLAVAIGPTIIVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 7004 - protein, 189 aa, Zea mays
  unsure (1)..(189): unsure at all Xaa locations
MDPTKFRPSSSHDTTVTTTNAGAPVWNDNEALTVGPRGPILLEDYHLIEKGAHFPRERIPERVVDPRGASPQGFFQXAPHLTALTWGQFLGAARGGTPRNRGFSTGVHQRGAPENIPEPRGVPREVYPPQGNWELVGNNFPRFFIREGIKFPHVVHAVQPHPRSHVEEYWRVVQFLAHLPERLDTFFFL

SEQ ID NO: 7005 - protein, 278 aa, Glycine max
  unsure (1)..(278): unsure at all Xaa locations
MFIESFKVESPNVKYTETEIQSVYNYETTELVHENNNGTYQWVVKPKTVKYEFKTNTHVPKLGLXVMLVGWGGNNGSTLTGGVIANREGISWATKDKIQQANYFGSLTQASAIRVGSFQGEEIYAPFKSLLPMVNPDDVVFGGWDISNLNLADAMARAKVFDIDLQKQLRPYMESMVPLPGIYDPDFIAANQGDRATNVIRGTKKEQVQQIIKDIKEFKESTKVDKVVVLWTANTEXYSTVVVGLNDTMENLFVXLXRNDAEIXLLDAMVMEMSFMEP

SEQ ID NO: 7006 - protein, 407 aa, Triticum aestivum
  unsure (1)..(407): unsure at all Xaa locations
MACGGGGESEAERRAELLREITEEGGFAFVASAEKAAAGDLRAAEAAREMAWEQLHSGPWSEVGSAWRDAYALACLHVARLRRAAADRRAALRALDMGLIMGGNLLRADLEAALASIAAEPSDGEGDGAEAVDEEANRWREGLDRNRDIADALKILPTKSXLSCSRXARRSCISLEEFICDHFLPETPVIISGCIDHWPAMTKWKDIQYLKKIAGDRTVPVEVGKSYVCSEWKQELITFSQFLERMWSTACPSNLTYLAQHPLFEQIFKLHEDIMVPDYCYAGGGELQSLNAWFGPHGTVTPLHHDPHHNILAQVLGRKYIRLYPGSVSEDLYPHTETMLSNTSQVDLDNIDMNEFPKVENLDFMDCILEEGDMLYIPPKWWHYVRSLSISFSISFWWRTTVISPSA

SEQ ID NO: 7007 - protein, 179 aa, Streptomyces coelicolor A3(2)
MTPDAGVGGALLGPYAALVVTASNRAAAGVYEDRGGPLIAEGLRRFGFAVDGPQVVPDGDPVRAALRAGVEAGFDVIVTTGGTGISPTDRTPEATRAVIDREVPGIAEAIRAYGRDKVPAAALSRGLAGVAGGTLIVNLPGSSGGVKDGLAVLEPLLKHAVDQIRGGDHPRPASGGGAS

SEQ ID NO: 7008 - protein, 363 aa, Zea mays
  unsure (1)..(363): unsure at all Xaa locations
MWRRCCCNCQVDESDAXENGHVKATINNIDGAITGLKDSATGKVEPQDAAPRIDIPVLSLDELIEKTDDFGSTALIGEGSYGRVYYAILDNGTKMAVKKLDSTENEPTAEFLTQVSLVSRLKHENFVDMLGYCMERNLRIVAYEFTTMGSLHDVLHGRKGVQGAQPGLALDWMQRVQIAVDAAKGLEYLHEKVQPSIVHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLMGEYPAKGLAKLAAVAALCVQYEAEFRPNMSIVVKALSPLLVTKQTPPPVVDS

SEQ ID NO: 7009 - protein, 472 aa, Escherichia coli
  unsure (1)..(472): unsure at all Xaa locations
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 7010 - protein, 502 aa, Paracoccidioides brasiliensis
MGADVASSTYRYTETPTYTTSNGCPVMDPESSQRVGMKGPLLLQDFHLIDLAHFDRERIPERVVHAKGAGAYGEFEVLDDISDITVIDMLLGVGKKTKCITRFSTVGGEKGSADSARDPRGFSTKFYTEQGNWDWVFNNTPVFFLRDPSKFPIFIHTQKRNPQNNLKDATMFWDYLSTHQESANRSCMHLFSDRGTPILPTGTCNGILGHHITQWTKPDGTFNYVQIHCKTDQGNKTFNNEEATKMAADNPDWHTEDLFKAIERGEYPSWTCTFRSSAPSRLEIRWNVFDLTKVWPQAEVPLRRFGRFTLCENPQNYFAEIEQAAFSPSHMVPGVEPSADPVLQSRLFSYPDTHRHRLGVNYQQIPVNCPLRAFNPYQRDGAMAINGNYGANPNYPSTFRPMEFKPVKACQEHEQWAGAALSKQIPVTDEDFVQPNGLWQVLGRQPGQQENFVHNVSVHLCGAQEKVRKATYCMFSRINADLGARIEKATERLVASQPQSHL

SEQ ID NO: 7011 - protein, 216 aa, Zea mays
MEKKAGREHVIGIPVNNRAFGIEEPDFSSKGAARNAAAAGRAAKSGWTTGDRVAQGLKEHVALGPNLYETVRGKLSLGARILRAGGVEKAFRRWFSVVGKGERLLRASQCYLSTTAGPIAGTLFVSTERIAFRSDRSLALTSPKRGTVVLVRVPYKVSIPLGRVKTATPGGNKDRPEQKYVQVVTDDGFVFWFMGFVRYQVSLHELEKAIKQAQAQ

SEQ ID NO: 7012 - protein, 503 aa, Streptomyces coelicolor A3(2)
MSNTLFRTKKIEQSIRDTEEPEHALKKSLSALDLTVFGIGVVIGTGIFVLTGTVAKDNAGPATALAFVVAGVVCALAALCYAEFASSVPVAGSAYTFSYASLGELPAWIIGWDLVLEFALGTAVVAVGWSGYIRSLMDNAGWHMPAELGGRDGAEGFGFDILAAALVLVLTAVLVLGMKLSARITSLVVAIKVAVVLIVIIAGAFFVKSANYDPFIPKSQPVEAGGGLHSPLIQLMFGWAPSNFGVMGIFTAASVVFFAFIGFDIVATAAEETRNPQRDMPRGILGSLIICTLLYVGVSIVVTGMQHYTKLSVDAPLADAFKATGHPFFSGVISFGAAVGLTTVCMILLLGQSRVFFAMSRDGLLPRFFSHVHPKFRTPYRPTILLGVIIAIVAGFTSLSELAELVNIGTLFAFVVVAISVIILRRTRPDLPRAFRTPLVPLLPIVSVAASLWLMLNLPAETWVRFAIWMAIGFVVYFLYGRTHSRLARGEEAPADPAEPSGT

SEQ ID NO: 7013 - protein, 543 aa, Yersinia pestis CO92
MTPGELRRLYLIIRVFLSYGLDELIPNIRLTLPLRVGRHLFFWLSNRHKDKSLGERLRLALQELGPVWIKFGQMMSTRRDLFPPNIADQLALLQDRVASFDGALARKHIEIAMGGALETWFDDFDSQALASASIAQVHTARLKENGKEVVLKVIRPDILPIIKADVRLMYRLAGWVPKLLPDGRRLRPREVVREYEKTLLDELNLLREAANAIQLRRNFEDSPMLYIPEVYSDYCRESVLVMERIYGIPVSDIAALEDQGTNMKLLAERGVQVFFTQVFRDSFFHADMHPGNIFVSYEHPHDPLYIGIDCGIVGSLNKADKRYLAENFIAFFNRDYRRVAELHVDSGWVPRDTNVEDFEFAIRTVCEPIFEKPLAEISFGHVLLNLFNTARRFNMEVQPQLVLLQKTLLYVEGLGRQLYPQLDLWTTAKPFLESWLRDQVGLPAVIRALKEKAPFWAEKFPELPELVYDSLQQHKLLQQSVEKLTIQIQGQQQRQGQSRYLFGVGATLLVSGTILFLADATEVSTGFIVAGALAWFIGWRRTC

SEQ ID NO: 7014 - protein, 246 aa, Pinus armandii
YTYSLRKKGPEDVIVKVIYCGICHSDLVQMRNEMGMSNYPMVPGHEVVGMVTELGSEVKKFKVGDHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKRCGILGLGGVGHMGVKIAKAFGLHVTVISSSDKKKEEAMEVLGADAYLVSKDAEKMMEAAESLDYIMDTIPVAHPLEPYLALLKTNGK

SEQ ID NO: 7015 - protein, 499 aa, Azotobacter vinelandii
MTQANIIGHFIGGQLQQAGVRHSDVFNPALGQVTARVALASRDTVDAAVAAAKAAFPAWSERSALQRSRILFKFKELLDKHHKELAAIITSEHGKVLSDAMGEVTRGIEIVEFACGAPHLLKTTLTDNIGGGIDNWNMRQALGVCAGITPFNFPVMVPLWMIPMALATGNTFVLKPSERDPSASLLLADLLKRAGLPDGVFNVVQGDKDAVDALLQHPDVEAVSFVGSTPIAEYIYQEGTRRGKRVQALGGAKNHMIVMPDANLDQAADALIGAAYGSAGERCMAISLAVAVGDTGDALIEKLLPRIDRLRVRNGTDAEADMGPLVTAQHKAKVEGYISKGVEEGARLIVDGRDFKAPGAENGFFVGATLFDQVKTDMTIYKEEIFGPVLGIVRVPDFAAAVELINAHEFGNGVSCFTSDGGVARAFARAIKVGMVGINVPIPVPMAWHSFGGWKRSLFGDHHAYGEEGIRFYTRYKSVMQRWPDSIAKGPEFSMPTAK

SEQ ID NO: 7016 - protein, 85 aa, Triticum aestivum
WLSSATCVAPFQGLKCTGVLRVSRRSNGASLGSVSIGGRIRCMHVWSFEGIKKFETLSYLPPLSTVALLKQVDYLMRSKRVPWLE

SEQ ID NO: 7017 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 7018 - protein, 676 aa, Escherichia coli O157:H7 EDL933
  unsure (1)..(676): unsure at all Xaa locations
MKLAACFLTLLPGFAVAASWTSPGFPAFSEQGTGTFVSHAQLPKGTRPLTLNFDQQCWQPADAIKLNQMLSLQPCSNTPPQWRLFRDGKYTLQIDTRSGTPTLMISIQNAAEPVANLVRECPKWDGLPLTLDVSATFPEGAAVRDYYSQQIAIVKXGQITXQPAATSNGLLLLERAETDASAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKTLGERWSDWKPAAGQTWHSFNDYINFSDKTGWDKWWGKNWIRTDIGDYDNPGFDDLTMSLAFLPDIKTESTTASGLPVFYKNKTDTHAKAIDGFTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCIAQMDTTWQQMAEKLQGFNVLSYLSSHDTRLFREGGDKAAELLLLAPGAVQIFYGDESSRPFGPTGSDPLQGTRSDMNWQDVSGKSAANVAHWQKISQFRARHPAIGAGKQTTLSLKQGYGFVREHGDDKVLVIWAGQQ

SEQ ID NO: 7019 - protein, 513 aa, Magnetospirillum magnetotacticum
MTSGPGATNAVTGLADAQCDSVPLVCLTGQVPTHLIGNDAFQEADITGITRPCTKHNYLVKDVNELARTVHEAFHVARSGRPGPVLIDLPKDVVQAKGEYQPPSKLKSKYKPQVKGDLKAIEKAVEMIAHAKRPIFYVGGGVVNSGPAACQLLTQFVRMTGYPCTLTLMGLGAFPGSDPLFLGMLGMHGTVEANMAMHDCDLMINIGARFDDRVTGKLEGFSPKSKKIHVDIDPSSINKNVAVDLPIVGDCAHVLEDMIKVWKAKQARVDDKALKAWWAKINQWRGTDCLSFENSNKIIKPQYAIQRLYEMTRHRNPYFCTEVGQHQMWAAQHLRFDLPLHWLTSGGLGTMGYGLPSAMGVQMAHPDALVINIAGEASIQMNIQEMATLVQHRLPVKIVILNNQYLGMVRQWQELIHGGRYSESHMIHHPDFVKLAEAFGAVGLRAENPGEVDGAIKEMIAVDRPVILEMRTDASENVFPMIMPGMAHNEMVLGPEDKGRDKPGSEQDGMVLV

SEQ ID NO: 7020 - protein, 359 aa, Glycine max
MSPPSMLGNRKDGSEIAVAENYADINWDELGFSLVPTDYMYVMKCAKGDKFSQGSIVPFGNIEISPSAGILNYGQGLFEGLKAHRTEDGHVLLFRPDENAQRMKRGADRLCMPSPSPGQFVNAVKQIVIANKRWVPPPGKGSLYIRPLLIGTGALLGVAPAPEYTFLIYCSPVGSYQKGALNLKVEDKLYRAISGCGGTGGIKSVTNYAPVYTAMADAKANGFSDVLFLDSATGKHIEEASACNVFVLKDNAISTPAIDGTILPGITRKSIIDIAIDLGYQVMERSVSVEEMLGADEMFCTGTAVVVNSVASVTYKETRVDYKTGPATLSSKLRKTLVGIQTGCLEDKKSWTVRVDSTI

SEQ ID NO: 7021 - protein, 129 aa, Triticum aestivum
SQSAGYPELKIAMAGSVGSDPLGSFYRAKLRRANVHFLSKPVKDGTTGTVIVLTTPDAQRTMLAYQGTSSTLSYDSDLASLVSKSNVLIVESYLFELPHTIEAIKQACEDAHKNGALIAVTASDVSCIK

SEQ ID NO: 7022 - protein, 379 aa, Oryza sativa
RVGGIGNPTPRGKKPFAPWREVPPQVTHTLPPEKKEVFDSLEGWAADTILPYLKPVEESWQPQDHLPDPRSPSFGDEVAALRERAAGLPDDHLVCLVGDMVTEEALPTYQTMLNTMDGGVRDETGAGGSAWAVWTRAWAAEENRHGDLMNKYLYLTGRVDMRQVEKTIQYLIGSGMDPRTENDPYMGFIYTTFQERATSISHGNTARHAGRHGDAALARVCGTVAADEKRHEAAYAAIVAKLFEVDPDYTVRAFARMMRRKVAMPARLMYDGADDRLFARFAAVAQRLGVYTAADYAGIIEFLVARWGVPGLAAGLSGEGRRAQDFVCSLGPRFRRMEKRAQEAAKRAPPAAAAPFSWIHGRQVQLRGSSSSCNFSVRA

SEQ ID NO: 7023 - protein, 218 aa, Listeria monocytogenes EGD-e
MGKIAPSILSADFATLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKEIVDKKGLDIEIEVDGGVDHETAKLCRDAGANVFVAGSYIYGNKNRQTPIDKLRAIVGE

SEQ ID NO: 7024 - protein, 200 aa, Zea mays
MAEPGLEGSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPDLIYRMKQPKIVLLIFVSGKIVLTGAKVREETYTAFENIYPVLSEFRKIQQ

SEQ ID NO: 7025 - protein, 434 aa, Chloroflexus aurantiacus
MLPSMTGVRTLSSIIHACPYRFITIFECVARFTVQAVIAVLPGDGIGPEVVAEGVKVLQAIARRFGHQFTFHEALIGGCAIDATGEPLPAATITLCQSADAVLLGAVGGPKWDDPQARVRPEQGLLGIRKALGLFANLRPVRIYPQLINASPIRPERLQGVDLIVVRELTGGIYFGEKRRERTADGEWASDLCIYTEEEIVRVVRVAARLARQRRGKVTLVDKANVLETSRLWRSITTRLMQTEFPDLQFETMLVDACAMHLIRRPADFDVIVTENMFGDILTDEASMLAGSMGMLPSASLADGRLGLYEPIHGSAPDIAGQGKANPLATILSVAMLLRYSLDLTAKRLCRSGSGSGSTANVTAFAFRTAGSAEPRIRILDALMADATRPSHHLTEGPRNCCGPPENWQSATFSKNSAPQFGKRPICDHKNGGD

SEQ ID NO: 7026 - protein, 270 aa, Zea mays
  unsure (1)..(270): unsure at all Xaa locations
PARDKIITAYRCHPFAVLRGGTIKGVIAELLGRKDGISKGKGGSMHMFTPTFFGGNGIVGAQVPVGAGIAFAQQYLNTTNATFAMYGDGASNQGQVFEAYNMAKLWNLPAVFVCENNKYGMGTAAERSSMNTAYYTRGDVIPGLQVNAMDVLAVVAATKHTAKWTAVDGNGPLLMELVTYRYGGHSMSDPGTTYRTRDEIQTMRSSSDPIQGLKARMLDWGXVVEEAELKKIDKRKKXGVDHAVEEAKKSHGDAKGSVGHIYYRARADYM

SEQ ID NO: 7027 - protein, 415 aa, Osmundea osmunda
  unsure (1)..(415): unsure at all Xaa locations
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLVVERERMDKFGRPFLGATVKPKLGLSGKNYSRVVYEGLKGGLDFLKDDENINSQPFMRWKERFLYSMEAVNRSIAGTGEVKGHYMNITAATMEEMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLKQNLPQGIFFEQDWASLRKVTPVASGGIHCGQMHQLLDYLGNDVVLQFGGGTIGHPDGIQAGATANRVALEAMVIARNXGVDYVAEGPQILRDAAKTCGPLQTALDLWKDITF

SEQ ID NO: 7028 - protein, 388 aa, Salmonella enterica subsp. salamae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNARDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 7029 - protein, 621 aa, Actinobacillus pleuropneumoniae serovar 1 str. 4074
MAIDISHLDNPELAKIVALLATSITIVPLFKRIGLGSVLGYLVAGCLIGPSVLGLIQDPQAVVHLAELGVVMFLFIIGLEMHPELLWSMRKAIFGRGFLQVATCGVLLTLAGIYILGLTKEVAFIAGAGFTLSSTAIVMQVLEDKGIASTQKGQRIVSTLLFEDLAIVPLLATIAFLAPEQANEEKTFSLTSIGIAIVGIIILVVGSKWVMNPLFRMISKAKVREMMTAAALLVVLGAALLMEMSGLSMAMGAFVAGVVLSESSFRHQLEADIEPFRGLLLGLFFMGVGMSLDLNFVFNDLIWLLSIVAVCVLGKAFGVYIIALITRLPHREALMRTSIMSHGGEFAFVLFSAAAAAGLLDQDQQATFTAAVIVSMLISPLVMLLMQRMVARKASVEAPNMMGIEIAEDLENSVIVIGFGRFSQIVCQALLARGITVTVIDSSTDRIRAAATFGFKVYYGDGTRLDVLRASGLEKADCVVLGINNPARSALIVEQIKNEYPLTPIFARTYDRHSAIELTKLHVDFQIRETLESALVLSKAAMMKLGVDEVEATEIVENVRLLDRERFKEELIYGTSAELIRKYFTPKPFFKPQQEAEALNEDAAEILAEEAVESNAESKEK

SEQ ID NO: 7030 - protein, 388 aa, Glycine max
  unsure (1)..(388): unsure at all Xaa locations
MAGGQLGVLNALDVAKTQWYHFTAIVIAGMGFFTDAYDLFCISLVTKLLGRLYYTDITNPKPGALPPNVQAAVTGVALCGTLAGQLFFGWLGDKMGRKRVYGLTLMLMXVCSLASSLGTHTWDKVKXLTDENNKYGLFSKEFAKRHGLHLVGTTVTWFLLDIAFYSQNLFQKDIFTAIGWIPPAQDMNAIHEVYRIARAQTLIALCSTVPGYWFTVAFIDIIGRFAIQLMGFFFMTVFMFALAIPYNHWKNHNNIGFVVMYSFTFFFSNFGPNATTFVVPAEIFPARLRSTCHGISAAAGKAGAIVGAFGFLYAAQSTNPNKVDHGYPTGIGVKNSLIVLGVINFFGMVFTLLVPESKGKSLEELSGENEDDGAEAIEMAGSARTVPV

SEQ ID NO: 7031 - protein, 116 aa, Glycine max
  unsure (1)..(116): unsure at all Xaa locations
RRPYVESSCSKEKLNALVDKCKDRTSLTYMAVNXDGSWKSNVGQTDVNAVTWGVFPAKXIIQPTIVDPVSFNVWKDEAFEIWSRGCITLRXTSYFLVSLVDNDYINGDLFTVFADF

SEQ ID NO: 7032 - protein, 400 aa, Glycine max
  unsure (1)..(400): unsure at all Xaa locations
MVLEATMICIDNSEWMRNGDYSPSRFQAQTDAVNLICGAKTQSNPENTVGVLTMAGKGVRVLVTPTSDLGKILACMHGLEIGGEMNLAAGIQVAQLALKHRQNKKQQQRIIVFAGGPVKHEKKMLEMIGRKLKKNSVALDIVNFGEEDEGKTEKLEALLSAVNNNDTSHIVHVPSGPNALSDVLISTSIFTGDGEGVSGXFCSISCNAINFLIVLFIQPQQKNDAKPIKRGGEEVIFETPFALXGFIFLVAFFAAVTNRGNYLRMFQCVSLHFNWNQCYVPVIEYWMIFXLPMQVIAMSMDDSAISHDVKDTDMSEASASDPDLALALQLSITDSAKDQSSQSDMSKLLADQSFVSSILASLPGVDPNDPSVKDLLASMQNQSEPQQKNDDKPSNEEEKK

SEQ ID NO: 7033 - protein, 98 aa, Glycine max
  unsure (1)..(98): unsure at all Xaa locations
MSSAVENFQLVLDSHRWVPLPGVGFSAHTVGDENHEDVTPPSNLMEHPPLAXXINGESSKCFPLDIMRKCLXXXXXXXXXHMLTHGLVMFQESYIKLQ

SEQ ID NO: 7034 - protein, 718 aa, Bacillus circulans
MFQMAKRAFLSTTLTLGLLAGSALPFLPASAVYADPDTAVTNKQSFSTDVIYQVFTDRFLDGNPSNNPTGAAYDATCSNLKLYCGGDWQGLINKINDNYFSDLGVTALWISQPVENIFATINYSGVTNTAYHGYWARDFKKTNPYFGTMADFQNLITTAHAKGIKIVIDFAPNHTSPAMETDTSFAENGRLYDNGTLVGGYTNDTNGYFHHNGGSDFSSLENGIYKNLYDLADFNHNNATIDKYFKDAIKLWLDMGVDGIRVDAVKHMPLGWQKSWMSSIYAHKPVFTFGEWFLGSAASDADNTDFANKSGMSLLDFRFNSAVRNVFRDNTSNMYALDSMINSTATDYNQVNDQVTFIDNHDMDRFKTSAVNNRRLEQALAFTLTSRGVPAIYYGTEQYLTGNGDPDNRAKMPSFSKSTTAFNVISKLAPLRKSNPAIAYGSTQQRWINNDVYVYERKFGKSVAVVAVNRNLSTSASITGLSTSLPTGSYTDVLGGVLNGNNITSTNGSINNFTLAAGATAVWQYTTAETTPTIGHVGPVMGKPGNVVTIDGRGFGSTKGTVYFGTTAVTGAAITSWEDTQIKVTIPSVAAGNYAVKVAASGVNSNAYNNFTILTGDQVTVRFVVNNASTTLGQNLYLTGNVAELGNWSTGSTAIGPAFNQVIHQYPTWYYDVSVPAGKQLEFKFFKKNGSTITWESGSNHTFTTPASGTATVTVNWQ

SEQ ID NO: 7035 - protein, 204 aa, Zea mays
MGNPEKLMNQIFDLKFTSKSLQRQARKCEKEEKEQKLKVKKAIEKGNMDGARIYAENAIRMRTEHMNYLRLASRLDAVVARLDTQAKMQVIGKSMQSIVKSRDSSLATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 7036 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWVNFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 7037 - protein, 549 aa, Oryza sativa (japonica cultivar-group)
MAPIGVLTALDQARTQYYHFKAIVIAGMGLFTDSYDLFCIAPVMKIVGRVYYSDGGARPGVTPPAVVSATVGVALLGAVIGNVVFGALGDRVGRRRVYGACLLLMLRRERLLRVPDAPVRARQPLLLPFLLGVGVGGDYPLSATIMSEFANRRTRGAFIAAVFSMQGFGILASSAVTMAVAAAFDHYTGYPAPLDTPECADLAWRIILMAGAVPAALTYYWRMSMPETARYTALVERDVVKATNDIGRVLADLDLGAVAEEEVAAALSRPPPPPRPSYGLLSRRFVRQHGRDLFACAAAWFLLDIPYYSSTLFQSQIYRPLFPAPGLINAFQEAFNVAKFQAVIAVASTIPGYFVAVLLIDRVGRRCLQMAGFLLMAVFLFALAGPYDGYWRDHGAHAGYIVLYSLTFFSANLGPNTTTFILPAELFPARFRSTCHGLSGAAGKLGALVGSIGFLWASQQKDGAAAGHLPGIGMMYALFVLGGICLLGLALTYVFTPETMMRSLEENESDRAQTQVGDGGSDTEAAKSPASMASSHLSMSPILPARVSV

SEQ ID NO: 7038 - protein, 136 aa, Triticum aestivum
  unsure (1)..(136): unsure at all Xaa locations
MAPAVMASSATTVAPFQGLKSTAGLPVGRRSSGSLXQASSNGGRIRCMQVWPIEGIKXKFENLSYLATLSKXGLLKQVHYLIRSXKWVAXLXFNKXGFXXRXXNXSPGYXEGRYWAMXELPMFRCTDPNKVLXEGE

SEQ ID NO: 7039 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 7040 - protein, 121 aa, Zea mays
INVPRSRFLPVKATSDLLLVQSDLYPLVEGFVIRNPSRANPVNPSIELGPEFKKVANFLGRFKSIPSIVELDRLKVSGNVWFGSGITLKGKVPIPPKFGVKLEVPNGAVFENKDVNGPEDF

SEQ ID NO: 7041 - protein, 510 aa, Triticum aestivum
  unsure (1)..(510): unsure at all Xaa locations
YVLLFRVESPNVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIXLKAEGEDKFHSFHPVATILSYLTKXAPLVPPGTPVVNALAKQRAMLENIMRACVGLAPENNMILEYM

SEQ ID NO: 7042 - protein, 368 aa, Ralstonia metallidurans
MAYKAVDLRRSSQNNPFRLTSLSDTWRQPAHPPCRIIAGRGYCNPPIRDKSNMRMLSTLALAAGLACAPLIAPTSVSSAYAADIQATGKSDKQALIADLIGRMTLDEKIGQLRLISIGPEMPQPQLIKEIAAGRVGGTFNSITQAENRPLQDAAVMQSRLKIPMFFAYDVVHGHRTVFPISLGLASSWDMGLVEKTARISAVEAAADGIDATFAPMVDISRDPRWGRTSEGFGEDPYLVSQCARASVKGFQGASPANADSLMAFVKHFALYGAVEGGRDYNTVDMSLQRMYQDYLPPYRAGLDAGAGGVMIALNSINGQPATSNRWLLHDLLRKEWGFKGVTVSDHGAIDELLRPAWPATAAGGKLAS

SEQ ID NO: 7043 - protein, 192 aa, Glycine max
MPSLFSKHLHLCFLKLKYPTILCQPHHSDHTPPPSSSDNSTIFPFTDTTTTTSSGSSTEPDFASIFASQRFFFSSPGTSNSIVESPDTRTFMIPTGGGVRVPKYSLNPYVDFLRSMQEMIRSRQVLDITKDSEYLHELLLCYLALNPTHTHKFILRAFTDLVLELLSSTTPCRTTHNHNSHRRHRSLSGRLL

SEQ ID NO: 7044 - protein, 500 aa, Mycobacterium tuberculosis CDC1551
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPIPPAGICSRAGSPTRVAAADPAGRDIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 7045 - protein, 355 aa, Solanum tuberosum
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVLPLRGALVLNVGDLVHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 7046 - protein, 597 aa, Bifidobacterium longum NCC2705
MGCLDVRFCRIIFALYSLIRKYGAWLVIPAMLGGAAFLADSVLTPAVSISSAVEGLKTLPALEHLFTENKDLTMMITAVIIVILFAVQSRGTESIGKVFGSVVMVWFAFLAIVGVVAIGNDWSVLAALNPYYGIKFLFSPNNATGLALMGTVFLSTTGAEALYSDMGHVGRGNIYFTWPFIKVALVLNYFGQGAWMLHNQNNPELADAEGINPFFQMMDPNVRYVAVVLSVTAGIIASQALITGAFTMVSEATGLNWMPHLQVCYPARTRGQLYIPVVNVVLCVATLAVLLLFRDSEHISAAYGLALTITMITTTILLGIYLWHRSNKFGAVVFTIVFLAIQVLFFAASMAKFLHGGWFTLLLTLAILMIMYTWNEGTKLERSQRRHMMPKDFLPALDKLHGDSRIHRFADNIVYLTSDPDLKRLDTDIFFSIFADHPKRARAWWAVAVETTDEPFTREYSVESFGTDYLFRVRIRLGFKVSQSIPAYLHQIMHDLEKTGELPNQQSIYPKLDADPGIGTIRYVVIHKALMPESKVSGRGALSLQIKYAIRRVAGSPVKWFGLAPYNPLVEVQPLFVSTRRPPRLTRVASQAPKREG

SEQ ID NO: 7047 - protein, 522 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEAYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLSK

SEQ ID NO: 7048 - protein, 387 aa, Glycine max
  unsure (1)..(387): unsure at all Xaa locations
MEEYTNNNHLSENTGPSPSTPRPNFLYSSASGGNHNHNHHQHHSHHHHHQFPINTFHLQSGGSDHCFQSDQVSPHHSVKSEASTSQLHAPIFHYPLMRGNLHNTMHHHHPQQQQGGSPTSSTGEVEAIKAKIIAHPQYSNLLEAYMFNQXIGAPPEVVARMAAAKQEFEARQRSSVGSRETSKDPELDQFMEAYYDMLVKYREELTRPIQEAMDFMRRIETQLNMLCNGPVRIFSDDKCEGAGSSEEDQDNSGGETELPEIDPRAEDRELKNHLLKKYSGYLSSLKQELSKKKKKGKLPKDARQKLLNWWELHYKWPYPSESEKVALAESTGLDQKQINNWFINQRKRHWKPSEDMQFMVMDGLHPQSATLYMDGHYMADGHYRLGP

SEQ ID NO: 7049 - protein, 480 aa, Meristotheca papulosa
TRIKNERYESGVIPYAKMGYWDPEYVVKETDVLALFRVTPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKRLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVTEGPQILQDAAKTCGPLQTALDLWKDITFNYTSTDTADFVETPTANV

SEQ ID NO: 7050 - protein, 459 aa, Cruciplacolithus neohelis
DPEYSIKETDILALFRCTPQPGVDPVEAAAALAGESSTATWTVVWTDLLTACDLYRAKAYRVDPVPSAADTYFCYIAYDIDLFEEGSLANLTASIIGNIFGFKAVKALRLEDMRLPYALLKTYQGPATGMVVERERLDKFGRPLLGATVKPKLGLSGKNYGRVVFEGLKGGLDFLKDDENINSQPFMRYRERFLYSMEGVNHAAAMSGEVKGHYLNATAATMEDMYERAEFSKELGSVITMIDLVIGYTAIQSMANWARKSDMILHLHRAGNSTYSRQKSHGMNFRVICKWMRMSGVDHIHAGTVVGKLEGDPLMIKGFYNTLLDFKTDINLPQGLFFAQDWASLRKCVPVASGGIHCGQMHQLLNYLGDDVVLQFGGGTIGHPDGIQAGATANRVALECMVLARNEGRDYISEGPQILRDAAKTCGPLQTALDLWKDITFNYASTDTADFVETPTANV

SEQ ID NO: 7051 - protein, 121 aa, Zea mays
  unsure (1)..(121): unsure at all Xaa locations
HRCTFLLKNQDGNEVFLRIKRSTQLMNAYCERQSXSVDMNAIAFLFDGRRLRGACRPTSPVASSFQHLTDIWHACPAGNGRNIISPVHSLPLAPATSALASTLASAAPVHRIDVFVISLSI

SEQ ID NO: 7052 - protein, 304 aa, Streptococcus pyogenes MGAS315
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFDILERQVPGAGNEVQLTDAIDTLNKTQRVFAREFKGNRYDVGDKFGFMKTSIDYALEHPQVKEDLKNYIIKLGKALEKSKVPTHSK

SEQ ID NO: 7053 - protein, 414 aa, Ostreococcus tauri
MGDRRTMVTDRVPTAWTRSRARWSGKRWRGECAWDRDGTVTDGATARDVGVKKNAANAATVAKSDGAEAVKENVRWHAAKSTSALPIEFGTPEMYQAVAQSVREGLFDRWNDTYAHFHKENPKQAYYLSMEYLQGRALTNAIGNMGLTGEYSDALRSLGYTLEDVMSVERNAGLGNGGLGRLASCFLDSIATLDLPAWGYGLRYKYGLFKQAVDKKTGEQLEFADDWLEVGNPWEVARPQTAYPINFYGKVVDGKWVPGQQVRAVAYDSPIPGYDTRNCISLRMWDAQPSAVDFDLASFNASDYETSMGPTNLAAMLCAVLYPGDGTREGKALRLSQQYMLCSASVQDILARWKERGNTDWTKLPEKVAIQMNDTHPTLAAPELMRILMDEEGLSWDDAWAITTKTVAYTNHTV

SEQ ID NO: 7054 - protein, 484 aa, Triticum aestivum
  unsure (1)..(484): unsure at all Xaa locations
MSGRVAAQQHAPVAPVDRGPALPPTLTPPRRGARKPEAEIARGEASPHPRTAPHRIGISPRHHSQPNPPAPRRRRRTTATAALGSPPAMASRMALRPHGVTXRSPPAAAAAGRASVRVLAVASSASAKIESKKTFAPPKEVHVQVTHSMPPQKMEIFQSLDGWARDNLLLHLKPVEKCWQPQDFLPDPASDGFHDEVKELRERAKEIPDDYLVCLVGDMWPEXITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLALADMMRKKIAMPAHLMFDGQDEKLFDHFSMVAQRLGVYTARDYADILEFLVGRWKVPELTGLSGEGHKAQDYLCTLAGRIRKLDERAQSRAKQAGKMPFSWVYGREVQM

SEQ ID NO: 7055 - protein, 936 aa, Saccharomyces cerevisiae
MDGEMAIIESSNHVGTSSPTTETQFTIDSSALKDQETKESITNSPTSEVPIETKLPKSSDIVTEEKHPQNTTTDIENEVENPVTDDNGNLKLELPDNLDNADFSKLLEFDAKNDEALFNSNELLSHTMDPVNNIDLTHDHSREVSSKEDINIEPVNPDEDEREKTQDNTAAVKTEGIRNSEDTSIQKDEPTADAIYTDVHKLSVNKDTETLPTLVDEKNNMLHMRNNSITPIMFQQHELVGQPPQNTVTENNSTDAETTQRKLSEPIDASLPLPNEQPTIFAYARLDFQSFTFYVQTLHAIIGRRSENDFSHKVDVNLGPSKSISRRHAQIFYNFGTGRFELSIIGKNGAFVDDIFVEKGNTVPLRNKTKIQIGQIPFQFILPEQERNDDSKSPENADIAESEINTRNLKKNEPKSKKKITTGAKPKKAQTKPAVKKEKKPPKIPKKVYTLEEIPVEYRTKPTVSYSAMLTTCIRKYSTAKGMSLSEIYAGIRELFPYYKYCPDGWQSSVRHNLSLNKSFRKVSKEGKGWLWGLDEEYIAERERQKKKQSEIAVAKAQAAQLKLEQQQHKLQQVPQRGKKDIVSQRSNVNARKQNISQTLAANRAASNRKNTASDNQRTMKYLQEQLVILTRDRKGLSKQVIAAILTQALAMTINQVTQAAKNKGITGNPLTALMDKNPQHLNLILAAAVNAATAKVTKGEVKQLVNPETTAAAALAAKAQHSKPIRQPIVQTPHVPDRPPSQLSASASSHPNNYLHDKQPGSFDPSSLSRFFQPRQNARATSSVAATSVPAAASQNVDAQPKPKPAQDNDLESESGTSSSSSSSSESGSESDSGSDDGSASGSGDNSSTSSESESESDSGSEVDEKNNKNEKIDSESIKNNESKDDIPSKDENSSNDNREISKTDEEGHDSKRRKVSEDINEGITEVNVSLEEKL

SEQ ID NO: 7056 - protein, 405 aa, Zea mays
TGDPPLGDIGNLVSVRPATGNPQEQVNRPITRSFGAQLVKKAQAKAAIKNAAILPARHAPRQERKAPVKQHPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 7057 - protein, 273 aa, Glycine max
FFFFSQAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSR

SEQ ID NO: 7058 - protein, 465 aa, Pterocladiella capillacea
AKMGYWDPDYTVKETDVLALFRVTPQPGVDPVEASAAVAGESSTATWTVVWTDLLTACDLYRAKAYKVDIVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIASSGEIKGHYMNVTAATMEDMYERAEFAKQLGTVIIMIDLVIGYTAIQTMAIWARRNDMILHLHRAGNSTYSRQKSHGMNFRVICKWMRMAGVDHIHAGTVVGKLEGDPLMIKGFYNTLLLTHLETNLPQGIFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 7059 - protein, 374 aa, Oryza sativa (japonica cultivar-group)
MATVSGTDRLRDLHAFDDTKAGVKGLVDAGVTTIPYFFRHPPDPLPVASPSEAAAAIPLIDLAKADVDRDHVVSQVTAAAETVGFFQVVNHGVAGELMEAMLAAVRRFNEEPLEAKVPYYTRDVASKVRFSSNFDLFRSPAANWRDTLVIEMWPEPPSPEEIPPPCRGVLEEYAAAARRLGERLLELLSEGLGLPAGYLGREAGCTDGLSVAANYYPACPEPEATMGATKHADPSFLTVLLQDTSGGLQALLDQPRRRWVDVPPVAGALVVNVGDFLQLVSNDRLRSVEHRVLPTGAAGPARVSVACFFRVEYASTRPYVPVVVGGGGARAAAVYRGTTAGEFLAHFNGKGLDGRSALDHFRIPAAASSPPPPL

SEQ ID NO: 7060 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 7061 - protein, 183 aa, Triticum aestivum
  unsure (1)..(183): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXTMWKLPMFGCTDATQVINEVEEVKKEYLTRIPHIGFDNMXQVXCVSLTPNGLQDRAKQSHRHIKCNF

SEQ ID NO: 7062 - protein, 365 aa, Triticum aestivum
VSSVACASCLRPTEEKTEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTAKMTLSDDVNLEEFVMTKDEFSGADIKAICTESGLLALRERRMKVTHPDFKKPKEKVMFKKKEGVPEALYL

SEQ ID NO: 7063 - protein, 280 aa, Magnetospirillum magnetotacticum
MGTRVLPATKVLPKELLPVVDKPLIQYAVEEAAEAGITEIVLVTARGKEMLADHFDRNAELERSLEARGKTELLDIARGTCPKGVSITCVRQPAPLGLGHAVLCARPVIGDEPFAVLLPDDLILGKPGCLKQLVDVWSETRGHVIAVENVPADQVDRYGILDVIEEKGRLIRARGMVEKPKPAEAPSTLSVIGRYILDASVFDALERRERGAGGEIQLTDAIARTLGEVSLHGARFLGTRYDCGNKAGYVAAIIDAALAHPETASAVLAHLEALSGRRAA

SEQ ID NO: 7064 - protein, 229 aa, Zea mays
MPLWGTAASAQPAAEGDAARAPSGSGGGGVKVIRSLLPTRRRLRLDPPAKLYFPYEPGKQVRSAVRIKNISKSHVAFKFQTTAPKSCFMRPPGGVLAPGESIIATVFKFVEHPENNEKPLDKCKVKFKIVSLKVKGPVEYVPELFDEQKDQVAVEQILRVVFLDAERPSPQMDKLKRQLAEAEAALEARKKPPEDNGTRIVGEGLVIDEWKERRERYLARQQEEGVDSV

SEQ ID NO: 7065 - protein, 308 aa, Saccharomyces castellii
MSSKEEVKKESNFAIDFLMGGVSAAVAKTAASPIERVKLLIQNQDEMIKQGSLDSKYKGIIECFQRTAKTEGIIAFWRGNTANVIRYFPTQALNFAFKDKIKAMFGFKKEEGYGKWFAGNLASGGAAGGLSLLFVYSLDYARTRLAADAKSSKKGGSRQYKGLIDVYKQTLATDGMAGLYRGFLPSVVGIIVYRGLYFGLYDSLKPAVLTGSLEGSFLASFLLGWIVTTGASTASYPLDTVRRRMMMTSGQAVKYDGAFDCFRKVVAAEGVSSLFKGCGANILRGVAGAGVISMYDQLQMIMFGKKFK

SEQ ID NO: 7066 - protein, 270 aa, Oryza sativa
MSLAAESPSPSSPSSSSGSDDFAALLDAELELTSAADSASAGDPSAATDDDDEGGDEEEEDVVVVVEQEDAIVEQSSTKRRRVEDQHRHQAVVMKSDEDTVGSSKDVKIDECPPHPGFFGGLCYRCGKRQDEEDVPGVAFGYIHKGLRLGTTEIDRLRGADLKNLLRERKLVLILDLDHTLINSTKLFDLSAAENELGIQSAAKEVVPDRSLFTLETMQMLTKLRPFVRRFLKEASDMFEMYIYTMGDKAYAIEIAKLLDPDNVYFGSKV

SEQ ID NO: 7067 - protein, 262 aa, Halobacterium sp. NRC-1
MTNYGLVIDQERCIGCQSCSLTCKQENNVPMGQFWNRVLTQGGDHVDTPSGDYPEGGDGGTLEMTYQPTACQHCENAPCVKVCPVNATYTRDDGIVEIDYDKCMGCRYCMAACPYNARVFNWDEPEHRPEDGTGDVAERPQGVVEKCTFCSHRVEDGLDPACVVNCPADARIFGDLDDDDSTVSKYIAEYDTHQLLDEKGTDPSTYYINGEMSPGRPWKSKKLESELDDDEAAKAARRRSGSVENGYDVTPHVPAETAGGDD

SEQ ID NO: 7068 - protein, 410 aa, Glycine max
  unsure (1)..(410): unsure at all Xaa locations
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSDIISVDGKEIKVVSDRNPANLPWKDLGIDLVIEGTGVFVDREGAGETHSSRELRRCSLLAPGKGDIXPTYVVGVNEYDYSPDEPIISNXASCTTNCLAPFVKVLDQKFGIIKGTMTTTHSYTGDQRLLDAXHRDLRRARAAXALNIVPTSTGAAKGSXALVLPTLKGKLNGIALRVPTXPNVSVVDLVVQVSKKTFAEEVNAAFRESADNELQGILSVCDEPLVSVDFRCTDVSSTVDSSLTMVMGDDMVKVIAWYDNEWGXYSQRVVDLADIVANKWK

SEQ ID NO: 7069 - protein, 580 aa, Streptomyces avermitilis MA-4680
MAKQNVAEQFVDILVRAGVNRLYGVVGDSLNPVVDAIRRNSAIDWIHVRHEGTAAFAAGAEAQITGKLAACAGSCGPGNLHLINGLYDAHRSMAPVLALASHIPSSEIGLGFFQETHPDQLFRECSHYSEMISNPKQMPRLLQSAIQHAVGQSGVSVVTLPGDVASEPAPDKAVETALVTSRPTVRPGDTEIDKLVALIDAADKVTLFCGSGTAGAHAEVMEFAEKIKSPVGHALRGKEWIQYDNPYDVGMSGLLGYGAAYEATNECDLLILLGTDFPYNAFLPTDVKIAQVDVRPERLGRRSKLDLAVWGDVRETLRCLIPRVKPKENRRFLDKMLKKHADALEGVIKAYTRKVEKHVPIHPEYVASVLDELAAEDAVFTVDTGMCNVWAARYISPNGRRRVIGSFSHGSMANALPMAIGAQFTDRNRQVVSMSGDGGFAMLMGDFLTLVQYDLPVKVVLFNNSSLSMVELEMLVAGLPSYGTTNKNPDFAAVARACGAYGVRVEKPKQLAGALKDAFRHKGPALVDIVTDPNALSIPPKISAEMVTGFALSASKMVLDGGVGRMVQMARSNLRNVPRP

SEQ ID NO: 7070 - protein, 291 aa, Arabidopsis thaliana
MASKSKQHLRYQPRKSVSRSTQAFTVLILLLVVILILLGLGILSLPNANRNSSKTNDLTNIVRKSETSSGDEEGNGERWVEVISWEPRAVVYHNFLTNEECEHLISLAKPSMVKSTVVDEKTGGSKDSRVRTSSGTFLRRGHDEVVEVIEKRISDFTFIPVENGEGLQVLHYQVGQKYEPHYDYFLDEFNTKNGGQRIATVLMYLSDVDDGGETVFPAARGNISAVPWWNELSKCGKEGLSVLPKKRDALLFWNMRPDASLDPSSLHGGCPVVKGNKWSSTKWFHVHEFKV

SEQ ID NO: 7071 - protein, 116 aa, Glycine max
VFMQLFSVREEKKLLKASQCYLSTTSGPIAGLLFISTDKVAFCSDRSIKISSPNGDDVRVHYKVSIPLTKLKSVNKSQNVEKPSPKYIEIVPVDNFDFWFMGFFNYQPFCRLLAAV

SEQ ID NO: 7072 - protein, 523 aa, Pichia pastoris
MILHTYIILSLLTIFPKAIGLSLQMPMALEASYASLVEKATLAVGQEIDAIQKGIQQGWLEVETRFPTIVSQLSYSTGPKFAIKKKDATFWDFYVESQELPNYRLRVKRNNPEVLKVDFTKQYSGYLDVEADDKHFFYWFFESRNDPQNDPIILWLNGGPGCSSLTGLFFELGSSRINENLKPIFNPYSWNGNASIIYLDQPVNVGFSYSSSSVSNTVVAGEDVYAFLQLFFQHFPEYQTNDFHIAGESYAGHYIPVFADEILSQKNRNFNLTSVLIGNGLTDPLTQYRYYEPMACGEGGAPSVLPADECENMLVTQDKCLSLIQACYDSQSAFTCAPAAIYCNNAQMGPYQRTGKNVYDIRKECDGGSLCYKDLEFIDTYLNQKFVQDALGAEVDTYESCNFEINRNFLFAGDWMKPYHEHVSSLLNKGLPVLIYAGDKDFICNWLGNRAWTDVLPWVDADGFEKAEVQDWLVNGRKAGEFKNYSNFTYLRVYDAGHMAPYDQPENSHEMVNRWISGDFSFH

SEQ ID NO: 7073 - protein, 213 aa, Glycine max
MAFAHYLLAVPVEPSPNFPTNPPKPNPSLSSSSSSSISSHCFNLSSSLRPKHSLFSRFRRICHKAKAKPQEPEVTVASDAFTQFKHLLLPITDRNPYLSEGTRQAIATTSALAKKYGADITVVVIDAQQKESLPEHETQLSSIRWHLSEGGLKDYNLLERLGDGNKPTAIIGDVADDLNLDLVVISMEAIHTKHIDANLLAEFIPCPVMLLPL

SEQ ID NO: 7074 - protein, 488 aa, Lycopersicon esculentum
MACSVDTLAPFLGPNTTNAVAAASYICNQFSGVSDRFVDTGYAIDSTYLLFSAYLVFSMQLGFAMLLAGSVRNTMNIMLTNVLDAAAGGLFYYLFGFAFALGGPSNGFIGRHFFGLKEIPSNSFDYMNFLYQWAFAIAAAGITSGSIAERTQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSEDEMAGMDLTRHGGFAYYHEEDPKLGMQMRRIEPTTST

SEQ ID NO: 7075 - protein, 79 aa, Glycine max
  unsure (1)..(79): unsure at all Xaa locations
QKEIAPIKDGTTXXVIVLTTPDASIRTMLAYQGTSSTVNYDASLANAVSKTNXXXXEGYLFELPDTIKTITKACEKARS

SEQ ID NO: 7076 - protein, 288 aa, GIBBERELLA ZEAE PH-1
MVLEAVMVVVDNSESSRNGDYQPTRFDSQVDAVNITFQSITQGNPESSVGLMSMGGKGPEVLVTLTTEQGKILEGLHRTKKKIGGSSHLKTGIQVATLALKHRQNRSQRQRIIVFVCSPVEESEKELTTLAKKMKKANISVDFVLFGDLDDDSTKNKLQLFIDTVKTNEGCHLVVIPPSSKLLSDQLVSSPILLGENAGGSGGAGGAGGGNDEFEFGFDPAMEPELALALRMSMEEEKARQEKAAREEEEAAKKASLGDVKEEDEGQGSSSKDQDKDKKGDGDKMDIS

SEQ ID NO: 7077 - protein, 346 aa, Oceanobacillus iheyensis HTE831
MYTAKARAVDGPHQPFHATEIKRRNLDSHDVLIEIKYSGICHSDIHTAHGEWGEVNYPLVPGHEIAGVVSDVGPEVTKYKVGDRVGVGCMVDSCGECENCRRGEEQYCHQGNVQTYGGVDKYGEPTQGGYSTHIVVTEDFVLRIPDNIELDVAAPLLCAGITTYSPLNHWNAGPGKKVAVVGMGGLGHMAVKIAHAMGAEVTVLSRTLNKKEDGLEFGAENYYATSEKETFETLAGSFDLIINTVSAKLDMDAYFSLLNLDGSLVNVGAPAEPLSVNVFSLIGHRRSFAGSLIGGIRETQEMLDFCAEHNIVPKIEVISADQIDEAYTRVLDSDVKYRFVIDVSTI

SEQ ID NO: 7078 - protein, 487 aa, Oryza sativa
MAHAVESMEKLRAAVSKLDEMSDEDKDSFMHLVSRYLMEEKEMIDWNKVERPTPEMVVPYDSLVQAPRDIPEIRNLLNKLAVLKLNGGLGTTMECVAPKCTIEVRSGLTFLDLAIMQTEFLNKKYGCSVPILLMNSFNTSLVNKKIVEKYTNIEIHTFNQNKYPRIITEKFLPLSSEGSTGSHCWYPPGHGDVFFSLCKSGILDTMLSQGKEYVFIASSENLGATVDIEILNHLIHNKNEYCMEVTPKTSADVKGGSLICYEGCMQLLEIFQVPYENVDEFQSIENFNMLNTNNLWVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKNFSGRQVLKVPFLQGEPKIKFKIMMPAQ

SEQ ID NO: 7079 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7080 - protein, 478 aa, Geobacillus stearothermophilus
MALPGGAAMNITIRLQFEKDIVSFSDIAAAIGKAGGDIVGIDVISSSKVHTVRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLDTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQLTNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFNSKVVERVRQAVVEAAYRTGVARKDNIPVGGYTGQ

SEQ ID NO: 7081 - protein, 330 aa, Bacillus subtilis subsp. subtilis str. 168
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 7082 - protein, 473 aa, Synechococcus sp. PCC 7002
MTQTATDVLRLIQEENIQIIDLKFVDLPGIWQHCSFYQDQLDEASFVDGVPFDGSSIRGWKAINESDMAMVPDPTTAWIDPFCKEKTLSLICSIKEPRTGEWYSRDPRSIAQKAVDYLAPSGIGDTAYFGPEAEFFVFDDVRFDQTENKGFYYVDSVEGRWNSGRKEPGGNLAHKPGYKQGYFPVPPTDTLQDMRTEMLLTMAKCGVPIEKHHHEVATGGQNELGFRFATLLKAADYLMTYKYVIKNVARKYGRTVTFMPKPLFNDNGSGMHTHQSLWKEGQPLFWGDRYANLSQLALHYIGGILKHAPALLAFSNPSTNSYKRLVPGFEAPVNLAYSQGNRSASVRIPLSGPNPKAKRLEFRCPDATANPYLAFAAMLCAGIDGIKNAIDPGDPLDVDIYDLTPEELSKIPSTPASLEAALEALQQDHDFLTAGGVFTTDFIENWIEYKLDAEVNPLRLRPHPYEFALYYDC

SEQ ID NO: 7083 - protein, 296 aa, Yersinia pestis CO92
MKCLKAVIPVAGLGTRMLPATKAIPKEMLPVVDKPLIQYIVDECVAAGVKEIVLVSHSSKNAIENHFDTSFELEAALESRVKRQLLKEIKNICPADVTIMQVRQGHAKGLGHAVLCAKSMVGDNPFIVMLPDVLLDDSTADLSKENLASMIKRFEETGHSQIMVEPVPKADVSKYGIADCGHVALAPGESTLMTAVVEKPSIAEAPSNLAVVGRYVLSKNIWPLLEKTPRGAGDEIQLTDAIAMLMQQEPVEAFHMTGKSHDCGDKLGYMKAFVTYGVRHHTEGEKFTAWLKQQLD

SEQ ID NO: 7084 - protein, 476 aa, Xanthonema debile
SDRYESGVIPYAKMGYWDADYNVKHTDVLALFRITPQPGVDPVEAAAAVAGESSTATWTVVWTDLLTACDIYRAKAYRVDPVPGTTDQFFAYISYQCELFEEGSLANLTASIIGNVFGFKAVKALRLEDMRIPFAYLKTFQGPATGLIVERERMDKFGRPFLGATVKPKLGLSGKNYGRVVYEGLRGGLDFLKDDENINSQPFMRWRERFLYCMEGINRAAAATGEVKGSYLNVTAGNMEDMYERAEYAKTIGSIIVMIDLVIGYTAIQSMGIWARKNDMILHLHRAGNSTYARQKNHGINFRVICKWMRMAGVDHIHAGTVVGKLEGDPLMVKGFYNTLLQSESEINLPQGIFFAMDWACLRKTVPVASGGIHCGQMHQLTYYLGDDVVLQFGGGTIGHPDGIQAGATANRVALESMVLARNEGRDYLNEGPQILRDAAKMCGPLKTALDLWKDITFDYTSTDTPDFVETATESK

SEQ ID NO: 7085 - protein, 310 aa, Staphylococcus sciuri
GFGRIGRLAFRRLQEVENIEVVAINDLTDDAMLAHLLKYDSTQGRFKDEVEVIEGGFRVNGREIKTFENPNPKELPWGDLDIDVVLECTGFFADKDKASAHIEAGAKKVLISAPASGDLKTIVYNVNHDELDGSEEIVSGASCTTNCLAPMAKVLNDEFGIVEGLMMTIHAYTGDQNTLDAPHAKGDFRRARAAAQNIVPNSTGAAKAIGLVIPELKGKLDGSAQRVPVATGSVTELTAVLDKEVSVEEINAAMKNATNDSFGYTEDEIVSSDIIGITYGSLFDATQTRVMTVGDRQLVKTAAWYDNEMS

SEQ ID NO: 7086 - protein, 387 aa, Oryza sativa
  unsure (1)..(387): unsure at all Xaa locations
MAAGSASLLLLMVVLCAAASGTALAAITDGLLANGNFERGPAPSQLRGTGVVGASAIPSWRTSGFVEYIPSGRKQGDMVLVVPEGSHAVRLGNEASIRQRLAGAARGARYALTFSAARTCAQAERLNVSASGQWAVLPMQTMYSSNGWDSYAWAWDAAADAFDVVIHNPGVTEDPACGPLIDSVAIRTLNPPRRTNSVRPGVAENLVKNGDFEEGPYIIPGTRWGVLIPSMVVDEHSPLPGWMVESLKAVKYIDSDHFAVPRGRRAVELLAGRESAIAQVIRTXVPGRQYALSFTVGDASNGCEGSLVVEAYAGRESTRVAHESAGRGGAAKRAVLPFRAAAARTRVVFFSSFYSTRSDDMSSLCGPVIDDVAVVSVRARRPAAKRG

SEQ ID NO: 7087 - protein, 339 aa, Methanothermobacter thermautotrophicus str. Delta H
MLLNGDGGCMEKTVVLTRSDVEGLLNMDDCLKAVEGAFVQEALGRVQMPPKMYLFFRRYNGDLRVMPSYLEELEMAGVKCVNVHPSNPDRHSLPTVMAVIELVDPETGFPIALMDGTHITDMRTGAAGGVSVKYLASRDASRLGIIGAGRQAWTQLMAISRVADLEEVSVYCRTPSTREKFALRASKEYEVPVRAATDPREAVEGMDIVVTVTPSRSPVVMADWVSPGTHICAMGADAPGKQELDPLILKNARVFYDSLEQATHSGEINVPITEGILRVDDLQGSLGDVMTGKIEGRTSPADVTVFDSTGLSIQDITTAWMIYERAVAGEVGLEVDLQG

SEQ ID NO: 7088 - protein, 140 aa, Triticum aestivum
  unsure (1)..(140): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATXVXNEVEESRRST

SEQ ID NO: 7089 - protein, 169 aa, Nicotiana tabacum
GLIVSFGEMLIDFVPTVSGVSLAEVPGFLKAPGGAPANVAIAVTRLGGKSAFVGKLGDDEFGHMLAGILKQNGVQADGINFDKGARTALAFVTLRADGEREFMFYRNPSADMLLTPDELNLEVIRSAKVFHYGSISLIVEPCRSAHLKAMEVAKEAGALLSYDPNLRLP

SEQ ID NO: 7090 - protein, 260 aa, Glycine max
  unsure (1)..(260): unsure at all Xaa locations
LSCFHACAHACAQIQEIKEAVQLPLTHPELYEDIGIKPPKGVILYGEPGTGKTLLAKAVAXLDIXTFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 7091 - protein, 337 aa, Zea mays; identical to SEQ ID NO: 717

SEQ ID NO: 7092 - protein, 460 aa, Hypnea boergesenii
WDPDYVIKETDVLALFRVTPQPGVDPVEASAAVAGDSSTATWTVVWTDLLTACDLYRAKAYKVDAVPNTSDQYFAFIAYDIDLFEEGSIANLTASIIGNVFGFKAIKALRLEDMRIPVAYLKTFQGPATGFISERERMDKFGRPFLGATVKPKLGLSGKNYGRVVYEGLRGGLDFLKDDENINSQPFMRWKERFLYSMEGVNRSVAATGEVKGHYLNVTAATMEDMYERAEFAKQLGSIIIMIDLVIGYTAIQTMAIWARKNDMILHLHRAGNSTYSRQKIHGMNFRVICKWMRMSGVDHIHAGTVVGKLEGDPLMIKGFYNTLLLPYLKKNLPQGIFFEQDWASLRKVTPVASGGIHCGQMHQLLDYLGIDVVLQFGGGTIGHPDGIQAGATANRVALESMVMARNEGRDYVAEGPQILLDAAKTCGPLQTALDLWKDITFNYTSTDTADFVETPTANV

SEQ ID NO: 7093 - protein, 339 aa, Odontella sinensis
MTVSLGINGFGRIGRLVMRAALENPDTTVVAVNDPFMNIDYAAYQIKHDSVHGMYPGSVEVDGDSLVFDGTTKVKFFAERDPASIPWGASGAEYVCESTGVFTTIEKASLHLKGGAKKVIISAPSANAPMFVMGVNHKSYDGSADVVSNASCTTNCLAPLAKVLHENFGIEEGLMTTIHAATATQLVVDGPSKGGKDWRGGRSAMANMIPASTGAAKAVGKVLPELNGKLTGMAVRVPTPDVSMVDLTVRTTKACTGAEIDAALKAASESEDLKGILGYTDLPVVSQDFVHDKRSSIVDSTACIHLSDTFHKVISWYDNEWGYSNRLVDLCLFMKTVDN

SEQ ID NO: 7094 - protein, 325 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIR

SEQ ID NO: 7095 - protein, 93 aa, Oryza sativa
  unsure (1)..(93): unsure at all Xaa locations
MEAPPTPLSGRVFLXRREKATIRKPKRLKQPGERHRXSWDADRQDRFVRRLADXLGHPKDSQELRFLWIDLLAKCDASLGMKIATRLNMKPHM

SEQ ID NO: 7096 - protein, 349 aa, Zea mays
  unsure (1)..(349): unsure at all Xaa locations
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYINSAXVKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASS

SEQ ID NO: 7097 - protein, 186 aa, Mesembryanthemum crystallinum
MASSMLSNAAVATTAASRSAGAQASMVAPFTGLKSVSAFPVTRKSSNDLSTVPSNGGKVQCMQVWPPLGKKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYDA

SEQ ID NO: 7098 - protein, 277 aa, Arabidopsis thaliana
MLVTTSSSCCGHWYVFQGICIGCKSKVHKSQFRKFDYIFKGLQLSNEAVALTKSLTTKHSCLNEKKLHLVLDLDHTLLHSKLVSNLSQAERYLIQEASSRTREDLWKFRPIGHPIDRLIKLRPFVRDFLKEANEMFTMFVYTMGSRIYAKAILEMIDPKKLYFGNRVITKDESPRMKTLNLVLAEERGVVIVDDTRDIWPHHKNNLIQIRKYKYFRRSGLDSNSYSEKKTDEGENDGGLANVLKLLREVHRRFFIVEVEEVLESMDVRSLLKEGYRL

SEQ ID NO: 7099 - protein, 422 aa, Oryza sativa
MGAEAKAPLLEGRRGATPAQTLGNIVVSIVGTGVLGLPYAFRTSGWLAGALGVAGAGAATFYCMLLLLDCRDKLREQEEVDHDGNYTYGDLGEKCFGAIGRYFTEVTIILSQTGGSVAYLVFIGQNICSVFPTTAAGGEEPPRRVSPAAVVLAVLLPAEAALSFIRSLSSLAPFSILADACTVLAVATVVREDVQLLAGRGGSPFQGRSALAGLWGVPFACGVAVFCFEGFCLTLALEASMSDRRRFRPVLLHAIAGVTAVYVCFGVCGYLAYGDVTRDIVTLNLPNNWSTAAVKIVLCVALALTFPVMMHPIHEIVEARLFPSAGGWARKRAAVQASRVAVVGAVTAVACFVPAFGEFAAFVGSTVCALLSFVLPALFHLRLVGAAASAWRRAVDGGFLLLGLAFAAHGLYTVVSGPLNMG

SEQ ID NO: 7100 - protein, 128 aa, Glycine max
  unsure (1)..(128): unsure at all Xaa locations
TQKNXGDAKKDXHKXPGTEHPTAPREEXKDQEDGEHNAKHTAEAGTNAQXGGEDPPETNPKRVFFFIDTKACNDLLLKANQIGSVTDSIEAVRMSKKSGWGVKASHISGETEDTSIADISVGLDTGLI

SEQ ID NO: 7101 - protein, 149 aa, Prochlorococcus marinus str. MIT 9313
MGRWLEHTVSSDINAPVEQVWAVWMDLEAMPRWMNWIESVKTLDDPSLTDWTLAAQGFRFHWQARISKQVEGQQLQWESIGGLPTKGAVRFYPESENRTAVKLSVTYELPRPLAPLMEPSILGGIVTRELQANLDRFRDLVESGYCVSS

SEQ ID NO: 7102 - protein, 506 aa, Glycine max
  unsure (1)..(506): unsure at all Xaa locations
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFIFVGVVLNAAAQDLAMLIVGRILLGCGVGFAKALIIFHILNVTTGIQFANLVNXGNNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 7103 - protein, 82 aa, Chenopodium rubrum
GFAWSWGPLGWLIPSETFPIETRTAGFAFAVSSNMMFTFLIAQAFLSMLCHMRAYIFIFFSVWIVVMGLFVVFLLPETKGIP

SEQ ID NO: 7104 - protein, 459 aa, Neurospora crassa
MGQNQSGMGGGQDPSKSKKDKKDKPKYEPPPKPTTRIGRKKKRQGGASAAAKLPSVYPTSRCKLRLLRMQRIHDHLLLEEEYVENQERLRKAKTAKDSNAPASELESSDRMADERSRVDDMRGSPMGVGVLEELIDDDHAIVSSTSGPEYYVSIMSFVDKDLLEPGASVLLHHKSVSIVGVLTDDTDPAVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAAENAPSIVFIDEIDAIGTKRYDSTSGGEREIQRTMLELLNQLDGFDDRGDVKVIMATNKIESLDPALIRPGRIDRKILFENPDQNTKRKIFTLHTSKMSLNEDVDLEEFIAQKDDLSGADIKAICSEAGLMALRERRMRVQMADFRAARERVLRTKQEGEPEGLYL

SEQ ID NO: 7105 - protein, 355 aa, Oryza sativa
RPRNAAFLAPLRTSSAVCTKAVSNSDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 7106 - protein, 205 aa, Oryza sativa
  unsure (1)..(205): unsure at all Xaa locations
NIIVDYPYVECTSSLIQALILFKGVHPGYRREEIDRIPKKGVLFLEXNQKNDGPWXGSWAVCFTYATFFAXKGLVAAGRTFQNSLSIRKACNFLLSKQLSTGGWGEDYLGCQVEEYIDSGRPHVVHTAWGMLGLIYAGQVELDPAPLYRAAKELINMQLETGEFPQQEILGSFNSSLFFNYTNYRNLFPIWALGEFHRRLLAKRA

SEQ ID NO: 7107 - protein, 165 aa, Triticum aestivum
  unsure (1)..(165): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGYYDGRYWXTMWKLPMFGCTDATQVINEVEEVKKEYPDAYVRIIGFDNMRQVQCVSSSP

SEQ ID NO: 7108 - protein, 101 aa, Glycine max
MGKNNTKILITALVMVVTAAMMIEEATSIPICGVNTNDLKKCSPAVTGNNPPPPTPQCCKVAKAANLECLCPYFTRSALDPAKIKALGTNCGITKKPSCLP

SEQ ID NO: 7109 - protein, 340 aa, Streptococcus pneumoniae TIGR4
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPPYGTGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 7110 - protein, 682 aa, Listeria monocytogenes EGD-e
MEIFLYVLALLVAIFISNLLNRFVPFVSVPLIQIGLGVLIAIMPITFNLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSLMDASISFFVIAIGGILVGLILSWLKFRLLKWVRGLGMEDVTFHMLIQILTPFIIYLAAEEIHVSGILAVVAAGIMHSMEQKKMDPQLVKLNVVSQSTWSVIIFVLNGLVFLLLGTQLPAITEVVWNDSGSSNLQVMAYILSITAALILLRFIWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRKRIYDLQQNNSSNRGMDERERAKRLEIIQWERENTQKMTDEGRIVATDSYRYQHYLNMMEQAIKQRFRTKVKTAWMFLYRLIMLVIHPKKWGRITHKVKKGISKDSERFQAIRQLREDNEILIISKLKEQLTKENVDIIGPLITEHTIFLERVRKEHSPRGKRAKFEQKKREVQVVAFQLERDIIQNMFEKGGISRELARDLRQNLNMIETYLYDDFLE

SEQ ID NO: 7111 - protein, 674 aa, Zea mays
  unsure (1)..(674): unsure at all Xaa locations
TRPGDESLEGKVLRLKQQYTLCSASLQDIIARFESRAGESLNWEDFPSKVAVQMNDTHPTLCIPELMRILMDVKGLSWSEAWSITERTVAYTNHTVLPEALEKWSLDIMQKLLPRHVEIIETIDEEVLDVQKVLMQIFFLLYELTYTFLYTXLKQLINNIVSKYGTTDTELLKKKLKEMRILDNVDLPASISQLFVKPKDKKESPAKSKQKLLVKSLETIVEVEEKTELEEEAEVLSEIEEEKLESEEVEAEEESSEDELDPFVKSDPKLPRVVRMANLCVVGGHSVNGVAEIHSEIVKQDVFNSFYEMWPTKFQNKTNGVTPRRWIRFCNPALSALISKWIGSDDWVLNTDKLAELKKFADNEDLHSEWRAAKKANKMKVVSLIREKTGYIVSPDAMFDVQVKRIHEYKRQLLNILGIVYRYKKMKEMSTEERAKSFVPRVCIFGGKAFATYIQAKRIVKFITDVAATVNHDSDIGDLLKVVFVPDYNVSVAEALIPASELSQHISTAGMEASGTSNMKFAMNGCILIGTLDGANVEIREEVGEENFFLFGAEAHEIAGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 7112 - protein, 434 aa, Neisseria meningitidis Z2491
MKKHIWAASLLPASLSAEPLNWWKPYSAVNSGDTAWVMTAAALVLLMTLPGLALFYGGMVRKKNLLSTMMHSFSIATLVGILWVAVGYSLAFTPGNAFIGGLGRVFLSGMQIDAAAQMLTVSPNAPTVPEPVFMFFQMTFAIISTAIITGAFAERMKYSAMMLFSGIWFLLVYVPGAHWVWGGGFMSKGGVLDYAGGTVVHINAGIAGLVAALVLGRRIGYGREAMPPHNMAMTLIGAAMLWFGWFGFNAGSALAADAAAGMAMAVTQVSAVFGAAGWLACEKIAGHKPSALGLASGAVSGLVGITPAAGFTGPSGAAAIGILTAAACFVSVTVVKHKLRYDDSLDAFGIHGFGGLVGGILTGIFFDNRIFGGDAAVWQQLWIQVKDGFVMAAYSGLMSWAILKVVGKICGGLRVGKDVEREGLDLNIHGERVE

SEQ ID NO: 7113 - protein, 404 aa, Shewanella oneidensis MR-1
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 7114 - protein, 61 aa, Glycine max
MVALWNLDLECSYKRNGIFPMLKRNSTVKLAPQRWQENAADGSFDVVVTFEEKVFDMVIEG

SEQ ID NO: 7115 - protein, 447 aa, Glycine max
MEPESGTSTSRNPSQLSWVNLSRNLLLAYQSFGVVYGDLSTSPLYVFTSTFKGKLQNHHDEETIFGTFSLIFWTLTLIPLLKYVFILLSADDNGEGGTFALYSLLCRHAKFNLLPNQQAADEELSSYKYGPSSQAIASSPLKRFLEKHKRLRTALLVVVLFGACMVIGDGVLTPAFSVLASVSGLKVTEKKLTDGELVLLACVILVGLFALQHCGTHKVAVMFAPIVIIWLVSIFSIGVYNTIHWNPKIVRAISPYYIIKFFSRTGKEGWVSLGGILLCITGTEAMFADLGHFTASSIRLAFAFVIYPCLVVQYMGQAAFLSKNLGSVDNSCYDSIPDPVFWPVFIIATLAAIVGSQAVITATFSIIKQCHALGCFPRVKVVHTSKHIYGQIYIPEINWILMILTLAITIGFQDTTIIGNAYGNLFPYEPLSLSLHAYGNLFPYAYG

SEQ ID NO: 7116 - protein, 460 aa, Arabidopsis thaliana
MSNILQNRRSSFSSSTKSSLAKRQAPSSSENSVKLMPAMTKKRAPLSNITNQKIASRLQNSDSVHCSNKSAKLKIAPSVCVNASFSSNLQQSIVPHKVASSPSKSDDGSVSMDETRSSSDSYKSPQVEYIENDDVSAVVSIERKALSNLFITPNSETIDNYCSRDVLSDMKKMDKNQIVNIDSNNGDPQLCATFACDIYKHLRASEAKKRPDVDYMERVQKDVNSSMRGILVDWLIEVSEEYRLVPETLYLTVNYIDRYLSGNVISRQKLQLLGVACMMIAAKYEEICAPQVEEFCYITDNTYLKDEVLDMESDVLNYLKFEMTAPTTKCFLRRFVRAAHGVHEAPLMQLECMANYIAELSLLEYTMLSHSPSLVAASAIFLAKYILDPTRRPWNSTLQHYTQYKAMELRGCVKDLQRLCSTAHGSTLPAVREKYSQHKYKFVAKKFCPSVIPQEFFNNS

SEQ ID NO: 7117 - protein, 776 aa, Phragmites australis
MSLEVEKPGGTESTNRLSLKRHDSLFGDAEKVSGAKHHGSEVSWSRTLHLAFQSVGIIYGDIGTSPLYVYSSTFPSGIKNNDDLLGVLSLIIYTLIIIPMLKYVFIVLYANDNGDGGTFALYSLISRYAKIRLIPNQQAEDAMVSNYSIEAPSSQLRRAQWVKQKIESSKAAKIALFTLTILGTAMVMGDGTLTPAISVLSAVSGIREKAPSLTQTQVVWISVAILFMLFSVQRFGTDKVGYTFAPVISVWFLLIAGIGLYNLVVHDIGVLRAFNPMYIVHYFKRNGKDGWVSLGGVILCVTGTEGMFADLGHFNVRAVQISFTGILFPSVALCYIGQAAYLRKFPENVGDTFYRSIPAPLFWPTFIVAICAAIIASQAMLSGAFAILSKALSLGCLPRVRVIHTSKKYEGQVYIPEVNFMMGLASIIVTIAFRTTTSIGNAYGICVVTTFSVTTHLMTLVMLLIWKKHIVFILLFYVVFGFTELIYLSSILSKFIEGGYLPFCFAVVLMTLMATWHYVHVKRYWYELDHVVPTNEMTTLLEKNDVRRIPGVGLLYTELIQGIPPVFPRLIKKIPSVHSIFVFMSIKHLPIPHVVPAERFLFRQVGPREQRMFRCVARYGYSDRLEESKEFAGFLADRLKMFIQEESAFAQNEAENDESSPSTEVPEAQTRPWRSTHSVVHSEEAIHPRVSNSGRITFLANHSVEEEKQLIDREVERGVVYLMGEANVSAGPKSSILKKIVVNYIYTFLRKNLNEGHNALSIPKDQLLKVGITYEI

SEQ ID NO: 7118 - protein, 506 aa, Streptomyces coelicolor A3(2)
MTDTPPATTTDSGAPAESDEHSLTAGPAGPVLLQDAYLIEQMAQFNRERIPERQPHAKGSGAFGHFEVTHDVSAYTKAAVFQPGTRTDLVARFSTVAGERGSPDTWRDPRGFAVKFYTSQGNYDMVGNNTPVFFVKDPMKFQHFIRSQKRRADSNLRDHDMQWDFWTLSPESAHQVTWLMGDRGIPRTWRHMNGYTSHTYMWINASGERFWVKYHFKTDQGIEYFTQHEADQMAAADTDYHMRDLFEHIRDGDFPSWTLHVQVMPYEEAAGYRFNPFDLTKVWPHGDYPLIPVGRMTLERNPTDNHAEIEQAAFQPNNLVPGIGPSPDRMLLARLFSYADAHRYRIGANYQQLPVNAPVVDVRTYSKDGAMAYRKTTDPVYAPNSKGGPAADTEHFGTPPSWETDGSITRTAYVSHAEDDDWGQPGTLVREVMDDAARDRLVDNVVDHLLNEVTEPVLQRAFAYWSNIDRTIGDRIAKGVRAKAGEKDFKAAEQRNPARQAMQDKA

SEQ ID NO: 7119 - protein, 467 aa, Glycine max
MAVCEAEALSSQNHIILFHLNFPFQISSFEVFVVLCIMEMERVFEFPHTHMDRRPRKRARLGWDIPEVPKAQVGLFCGQDVGTISSFAPSRGPSENTTSSLFVKPVARNGSPPWRDDDKDGHYMFALGENLTSRYKIHSKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGGALFQTHENLEHLAMMERVLGPLPQPMLKRVDRHAEKYVRRGRLDWPEGATSRESIKAVMKLPRLQNLVMQHVDHSAGDLIHLLQGLLRYDPSERLTAKEALRHSFFMRDQFRR

SEQ ID NO: 7120 - protein, 158 aa, Triticum aestivum
  unsure (1)..(158): unsure at all Xaa locations
GVSSSASYDIAXEGRMAVIRTTDDAGTPLGMRDLGGLAESISTTRSSKSESLRSLQSSYEQESPSAGRRRRVRFELPNEDAMDQQVKDELLALVEAKHAGAAYIMGHSYIKARRSSNFVKKFAIDVAYSFLRKNCRGPSVSLHIPHISLIEVGMIYYV

SEQ ID NO: 7121 - protein, 365 aa, Thermobifida fusca
MADTAKPKATGKTGSRRRAARNNADSHFNGEKPEVLLDYYRQMLLIRRFEERAAQAYTQARIGGYCHLNLGEEATIVGLMEALQERDYLFTNYREHGYAIAKGTHPREVMAELYGRSTGVSKGWGGSMHLFDARTRLLGGYGIVGGQLPLAVGAALAITYRGSDEVVMCQMGDGTTNIGAFHESLNIASLWNLPVIFVVINNFTGMGTPVERSSAEPELYKRGSAYRIEGVRVDGRDVLAVRDTATTLVERARSEHRPFLLEAFSYRMKGHSVVDPAKYRTKEEAEEALANDPIAMFEERLTEAGILTDEIKKEIAESVKAEVADAADFAENSPHPEVSTLFDYTYATPVANESRRMPADPVFAE

SEQ ID NO: 7122 - protein, 496 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGVI

SEQ ID NO: 7123 - protein, 292 aa, Corynebacterium glutamicum ATCC 13032
MVPAAGMGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 7124 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 7125 - protein, 522 aa, Ipomoea batatas
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTLFGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 7126 - protein, 496 aa, Staphylococcus aureus subsp. aureus Mu50
MELLKHLSQRQYIDGEWVESTNKNTRDIINPYNQEVIFTVSEGTKEDAERAILAARRAFESGEWSQETAEKRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 7127 - protein, 233 aa, Oryza sativa
MRKSSINGVHVIGVPVTAKAFGIEEEVSLARGQSFRKADGDHLAVSLSHPSPYTSFGYKHSSKGQVIHWVSKLSRRAQGFREHVTLGPKLSETVKGKLSLGAKILQAGGIERVFRKAFSAEKGERLVKALQCYLYTTGGPIAGMLFVSAKKVAFRSDRPVTVTSAKGDVARVPYKVVVPLRRIAQVRPSENADKPEEKYIHVVTVDGFEFWFMGFVSYQRSCKYMQQAISELQ

SEQ ID NO: 7128 - protein, 321 aa, Isochrysis galbana
SKVGINGFGRIGRLVCKAACMKDGATVTAVNDPFCDVEYAAYLFKYDSTHGRYKGTVTFDTASSTLIVDGQKIKFYACRNPNEVPWGEAGADIVCESTGIFTVIEKASMHLQGGAKKVIISAPSADAPMFVMGVNHTSYTKDINILSNASCTTNCLAPLAKIINDEYGIVKGLMTTVHATTATQKTVDGPSGKDWRGGRGAGQNIIPSSTGAAKAVGKVIPALNGKLTGMAFRVPTPDVSVVDLTCVLGKPASYAEICEFIKKSCEKPEYKGIMAYTDEEVVSNDFISDPASSTFDAKAGIGLDDTFVKLVSWYDNEWGYS

SEQ ID NO: 7129 - protein, 652 aa, Vibrio parahaemolyticus RIMD 2210633
MTGIFLQAFVYLVAAVIAVPLAKRLGLGSVLGYLIAGVVIGPIIGLVGEETTTIQHFAEFGVVMMLFLVGLELEPKMLWAMRNRLMGLGGLQVGGTVAAIMGIALYFEQPWTIALAIGLIFALSSTAIVLQTFSEKGLTKTEGGKNAFSVLLFQDIAVIPMLAFIPLLALPELVEQAQNAVQTAAQHHDDLNLVADLPGWAYGIVITASIAIVVVGGHFLSRPLLKYVASSGLREIFTATALMLVIGIAALMSLVGLSPALGTFLAGVVLANSEFRHELESNIEPFKGLLLGLFFITVGAGINFSVLFGDFWLIMALTIGVMVLKALVLFILALIFRVKGSNRWLFTLSLAQAGEFGFVLLSFSVQNHVIPFELSQTLALVVAISMFLTPGLFILFDRVILPRFETQSNERESDTIEETGTVIIAGIGRFGQIVNRLLVSNGVTTVVLDHQANQVDNMRQIGTRAYFGDATRPDMLHTAGIEHAAALVVAIDNQESSVELVKYVKHTYPKVKIIARAFDRGHGYLLRQAGADVIESETYHSALEMGGHAMKALGIHPFFVEQQKDTYKRVEARKSEMLYQAWEDDSEGERFDNNFRELFIQLEEKMAEEMRKDRHDKLSRSERGWTPPPKGYAENFDGENVQDITPPKEEAI

SEQ ID NO: 7130 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNLGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 7131 - protein, 108 aa, Zea mays
TSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 7132 - protein, 339 aa, Zea mays
  unsure (1)..(339): unsure at all Xaa locations
MAKIKIGINGFGRIGRLVARVALQSDDVELVAVNDPFISTDYMTYMFKYDTVHGQWKHHEVKVKDSKTLLFGEKEVTVFGCRNPEEIPWGSVGAEYVVESTGVFTDQEKAAAHLKXGGAKKVVISAPSKDAPMFXLVGVNEKEYKSDINIVSNASCTTNCLAPLAKVINGKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAESEGGLKGILGYVEEDLVSTDFQGDSRSSIFDAKAGVALNGNFVKRVSWYDNEWGYSTRVVDLIRHMNSTK

SEQ ID NO: 7133 - protein, 204 aa, Brassica napus
AGCVLHTAAVSRESEMAAAAAAKEDGQDPRIPKIASSIRVIPDFPKPGIMFQDITTLLLDTEAFKDTIDIFVERYKCKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 7134 - protein, 300 aa, Solanum tuberosum
RIGRLVARVALQRDDVELVAVNDPFISTDYMTYMFKYDSVHGQWKHHELKVKDEKTLLFGEKAVTVFGIRNPEDIPWAEAGADFVVESTGVFTDKDKAAAHLKGGARKVAISAPSKDAPMFVVGVNENEYKPELCIVSNASCITNCLAPLAKVINDRFGIVEGLMTTVHAMTATQKTVDRPSMKDWRGGRAASFNIIPSSTGAAKAVGKVLPSLNGKLTGMAFRVPTADVSVVDLTVRLEKEASYEDIQAAIKEESEGKLKGILGYTEDDVVSTDFVGDSRSSIFDAKAGLALSKNFVKL

SEQ ID NO: 7135 - protein, 354 aa, Nicotiana tabacum
MAADNIYDFVASNLLCTETKSLCFDDVDSLTISQQNIETKSKDLSFNNGIRSEPLIDLPSLSEECLSFMVQREMEFLPKDDYVERLRSGDLDLSVRKEALDWILKAHMHYGFGELSFCLSINYLDRFLSLYELPRSKTWTVQLLAVACLSLAAKMEEINVPLTVDLQVGDPKFVFEGKTIQRMELLVLSTLKWRMQAYTPYTFIDYFMRKMNGDQIPSRPLISGSMQLILSIIRSIDFLEFRSSEIAASVAMSVSGEIQAKDIDKAMPCFFIHLDKGRVQKCVELIQDLTTATITTAAAASLVPQSPIGVLEAAACLSYKSGDERTVGSCTTSSHTKRRKLDTSSLEHGTSEKL

SEQ ID NO: 7136 - protein, 63 aa, Prorocentrum minimum
MRGILVDWLVEVAEEYKLCADTLYLSVNYIDRFLSIHPVQRSNLQLVGIACMWIASKYEEIYP

SEQ ID NO: 7137 - protein, 291 aa, Bacillus subtilis
MKFRRSGRLVDLTNYLLTHPHELIPLTFFSERYESAKSSISEDLTIIKQTFEQQGIGTLLTVPGAAGGVKYIPKMKQAEAEEFVQTLGQSLANPERILPGGYVYLTDILGKPSVLSKVGKLFASVFAEREIDVVMTVATKGIPLAYAAASYLNVPVVIVRKDNKVTEGSTVSINYVSGSSNRIQTMSLAKRSMKTGSNVLIIDDFMKAGGTINGMINLLDEFNANVAGIGVLVEAEGVDERLVDEYMSLLTLSTINMKEKSIEIQNGNFLRFFKDNLLKNGETESHHHHHH

SEQ ID NO: 7138 - protein, 312 aa, Agrobacterium tumefaciens str. C58
MWCKRRFYFAPGGHDMLRSETARRDGDIRLSFEFFPPKNAEMDAQLWETVAELKKWDPDFVSVTYGAGGSTKAPTLDAVRRMIGDSHLPTAAHLTCVDASRDDVHQVIEEFRNAGVRHFVALRGDPSTGIGTAYQPHPEGYENAAALVKGLREIGDFEISVSAYPEKHPESASETVDIDMLKRKADNGATRALTQFFFDNDVFERYMERVTAAGITIPVVPGIMPIQNLTQLKRFAGRCGTSVPRFLDERFEGYDEDLEGRARVAAEVAAEQIADLQRRGFNEFHLYTMNRAPLVDAVLENLGLQRLRRSAA

SEQ ID NO: 7139 - protein, 468 aa, Gelidium pulchellum
  unsure (1)..(468): unsure at all Xaa locations
GVIPYAKMGYWDPDYAVKGTDVLALFRVTPQPGVDPVEXXXXXXGESSTATWTVVWTDLLTACDLYRAKAYKVEEVPNSSDQYFAYISYDIDLFEEGSIANLTASIIGNVFGFKAVKALRLEDMRIPVAYLKTFQGPATGIIVERERMDKFGRPFLGATVKPKLGLSGKNYGXVVYEGLKGGLDFLKDDENINSQPFMRWKERFLYSMEGVNRSIAATGEIKGHYMNVTAATMEDMYERAEFAKQLGTVIVMIDLVIGYXAIQTMAIWARKNDMILHLHRAGNSTYSRQKIHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTFGHPDGIQAGATANRVALEAMVIARNEGRKLVEEGPQILRDAAXTCGPLQTALDLWKDISFNYTSTDTADFVETPTA

SEQ ID NO: 7140 - protein, 497 aa, Pseudomonas putida KT2440
MTTLTRADWEQRAQQLKIEGRAFINGEYTDAVSGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHKDGAKLLAGGKRTLEETGGTYVEPTIFDGVTNAMRIAQEEIFGPVLSVIAFDTAEEAVAIANDTPYGLAAGIWTSDISKAHKTARAVRAGSVWVNQYDGGDMTAPFGGFKQSGNGRDKSLHALEKYTELKATWIKL

SEQ ID NO: 7141 - protein, 223 aa, Oenococcus oeni MCW
MSVIVAPSILAADYLNLGEQIKLVEGAGAKYLHIDIMDGDFVPSISYGPQWVKQIKASGSKLVLDVHLMVNHPEKLIDSFVSAGADIIGVHVEATAHIHRALQMIKNAGVHPEVVINPGTPVSAILPILYMVDQVLVMTVNPGFGGQKFLPEEISKISELHEYKKEHGLDFDIEIDGGVNNQTLVKAYEAGATVAVAGSYVYDKVDPAAKVKKLLEVTNFEVD

SEQ ID NO: 7142 - protein, 172 aa, Oryza sativa; identical to SEQ ID NO: 4488

SEQ ID NO: 7143 - protein, 126 aa, Oryza sativa
YRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDG

SEQ ID NO: 7144 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDTEAEAIELANSLPYGLASAIWTENASRAHRVAGQIEAGIVWVNSWFLRDLRTAFGGSKQSGIGREGGVHSLEFYTELKNICVKL

SEQ ID NO: 7145 - protein, 318 aa, Trichodesmium erythraeum IMS101
MTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 7146 - protein, 209 aa, Schizosaccharomyces pombe
KKTFGIQMDNFFALYRRYLLHTVKGYECDWDSIRPLGPEDMIDYGDLPLCKNAGKYLNRLAVVKLNGGMGNALGVNYPKAMIEVRDNQSFLDLSIRQIEYLNRRYDVSVPFILMNSYDTNDETCKVLRKYAGCKIDISTFEQSRYPRVFVDSQLPVPKAAPSPIEEWYPPGHGDIFDALVHSGTIERLLAQGKDYLFVSNIDNLGASVD

SEQ ID NO: 7147 - protein, 473 aa, Nostoc sp. PCC 7120
MYNKITPPTTGEKITFKNGEPVVPDNPIIPFIRGDGTGIDIWPATEKVLDAAVAKAYQGKRKISWFKVYAGDEACDLYGTYQYLPEDTLTAIREYGVAIKGPLTTPVGGGIRSLNVALRQIFDLYACVRPCRYYAGTPSPHKNPEKLDVIVYRENTEDIYLGIEWKQGSEIGDRLISILNKELIPATPEHGKKQIPLDSGIGIKPISKTGSQRLVRRAIKHALTLPKDKQQVTLVHKGNIMKYTEGAFRDWGYELATSEFRQETVTERESWILSNKEKNPNISLEDNARQIDPGFDALTPEKKAQIVKEVETVLNSIWESHGNGKWKEKVLVNDRIADSIFQQIQTRPDEYSILATMNLNGDYLSDAAAAIVGGLGMGPGANIGDSCAVFEATHGTAPKHAGLDRINPGSVILSGVMMLEYMGWQEAADLIKKGLSDAIANSQVTYDLARLLEPPVEPLKCSEFADAIIKHFG

SEQ ID NO: 7148 - protein, 361 aa, Thermobifida fusca
MTVSERKPPYLRSALDSIPPYRPGRKVVGPDGRSAKLSSNESPFGPLPSVRQAIADAAADLNRYPDPAAAELTAALARRFHVPEEHVALGAGSVGLLQQLLEATAEPGAEVVYAWRSFEAYPLLTGLAGATPIHVPLREETHDLEALAAAVTDRTRMVFVCNPNNPTGTAVRETELAEFLDTVPEHVLVVLDEAYREYVQDPRVPDGVQLYRDRPNVAVLRTFSKAYGLAALRVGFLIGHPQVVDAVRKTLVPFAVNHLAQAAAVASLAAEQELLERVAVTVKERERVRAALLADGWTVPETEANFVWLRLGEDTLDFAAACEQAGIAVRPFAGEGVRVSIGLPDDNDAFLTVARTYPKRN

SEQ ID NO: 7149 - protein, 200 aa, Magnetospirillum magnetotacticum
MARHQPGASPMTTYKLLLLPGDGIGPEVMAEVEKVVGWLNRAGLASFETERDLVGGAAIDVHGKPLADETLAKADAADAILLGAVGGPKWNGVAYDIRPEAGLLRLRKDLGLFANLRPAICYPALADASALKRELVEGLDIMIVRELTGGVYFGEPKEITTLEDGSKRAVDTQVYTTAEIERIAHVAFDLARKRGSLDRP

SEQ ID NO: 7150 - protein, 1023 aa, Arabidopsis thaliana
PRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 7151 - protein, 177 aa, Lemna gibba
MASSMMASTAAVARAGPAQSSMVAPFNACRSSVAFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 7152 - protein, 310 aa, Agrobacterium tumefaciens str. C58
MRKLWKRPEMTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 7153 - protein, 218 aa, Oryza sativa
  unsure (1)..(218): unsure at all Xaa locations
MAPLRTLVIFLLLLLALVPALSRPDGGGGGFYDPARVTQLSWRPRAFLYSGFLSHDECDHLVNLAKGRMEKSMVADNDSGKSIMSQVRTSSGILLIEARENAESIQILHYELGQKYDAHFDYFHDKNNLKRGGHRVATVLMYLTDVKKGGETVFPNAAGRHLQLKDETWSDCARSGLAXLHVNATTDPASLHGSCPEPKIHGWHQGFARILPQELRGL

SEQ ID NO: 7154 - protein, 90 aa, Artemisia vulgaris
MAVCGGVTECKNFENNVEIETIAKFAVEEHNKKENATLEFVKVVSAKEQVVSGKIYYITIETNDGKTYEAKLWVKPWENFQELQEFKPAA

SEQ ID NO: 7155 - protein, 502 aa, Zea mays; identical to SEQ ID NO: 2892

SEQ ID NO: 7156 - protein, 265 aa, Triticum aestivum
  unsure (1)..(265): unsure at all Xaa locations
PPPLKPHPPPRPAPLDSAGGSAGLDPVRLPATAGGFAGEGATTSEVFEGYAGQYCEISAALSRKCAAASALDGEKKQQKLSEIQADVQESESLIRRMDLEAXRSMQPSVKAGLLAKLREYKXSDLNNVKGEIKRLSAPNAQQATREELLESGMSDTLSASSDQRGRLMMTSERLNQSSDRIRESQRTVFETEEIGVSILQDLHNQRQXLLHAHTTLHGVDXTYIGKSKKILASMSKRMDRNKWIVGGIIATLVFAILFILYFKFA

SEQ ID NO: 7157 - protein, 282 aa, Escherichia coli
ALLLKTQLPSGSELSLYDIAPVTPGVAVDLSHIPTAVKIKGFSGENATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVIECAYVEGDGQYARFFSQPLLLGKNGVEERKSIGTLSAFEQNALEGMLDT

SEQ ID NO: 7158 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 7159 - protein, 320 aa, Zea mays
HTASSPVQVPHRPLVAFPSRRAMDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQDEVVTRIEERISAWTFLPPENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPVIEGQKWSATKWIHVRSFDLPVKQPGSSDGCEDDNILCPQWAAVGECAKNPNYMVGTKEAPGFCRKSCKVCAE

SEQ ID NO: 7160 - protein, 217 aa, Glycine max
MARRAEEEYDYLFKVVLIGDSGVGKSNLLSRFTRNEFCLESKSTIGVEFATRTLQVEGRTVKAQIWDTAGQERYRAITSAYYRGALGALLVYDVTKPTTFENVSRWLKELRDHADANIVIMLIGNKTDLKHLRAVATEDAQGYAEKEGLSFIETSALEATNVENAFQTILAEIYRIISKKSLSSNDPAANIIKEGKTITVGGAPEPNTNKPSCCTSS

SEQ ID NO: 7161 - protein, 532 aa, Brucella melitensis 16M
MRHRRMSNLSAVFRLMRAGWILTREGVISALPVEGLSGLPALGHRIAGFLARPRARQMERSERMSRAMNKLGPSYVKLGQFLATRPDIVGHDVAADLELLQDRLDFFPQAGAVAAIEGSLGRKIDDLYVRFDAPIAAASMAQVHPAEVMKDGAPQKVAVKVIRPGVRQRFARDLESFFMVARMQERHMPFTRRLRPVQVVETLSQTTRIEMDLRLEAAALSEIAENIKGDEGFRVPKVDWERTGRDVLTLEWIDGIKMSDIPALEAAGFDLKKLAETLIQSFLRHTLRDGFFHADMHPGNLFVDHQGLVVAVDFGITGRLDKQQRRFLAEILYGFITRDYMRVAEVHFEAGYVPYTHDVASFAQAIRAIGEPIHDQPAETISMAKLLTLLFEVTELFDMETRPELLMLQKTMVVVEGVSRTLDPHFNMWKAAEPVVGDWIRKNLGPQGMVLDAKESAYALLHFTRKTPELLQRIDRISVALDTMAANGLRFDDATAEAIGRAEAQHSRWGRIAQVVIAVSMAAIAIKLYIWL

SEQ ID NO: 7162 - protein, 307 aa, Zea mays
SARQSPFFRDLATPIPSHRGVSRFASGASPSSTPPPPPPIFTLDDRYASADFSPDPTASDLLPVASSPSPRTAASRSPPWDLSRGKVALSAPGSPMAGVVEPTRKEMLALPAPASPGTPPPAATAEAQSPVTPAQAPRTEPVANAGEVEREEWVTVFGFSIGDTNLILREFEKCGVILRHHSGPRDGNWIHILYQRSYDARKALQKNVIQLSSSLIVGVKPIDAVHRQQLDESFAPSNPGGFMVSLPSKSLGLKSTGASNQLGGFNRLYDLKANTNVSRDAGRRATGSVAAPAKSIVTNVMDLVFGI

SEQ ID NO: 7163 - protein, 156 aa, Zea mays
LSVRSTRTCVPSVSAMAAAAAAPASVASVDASELEKHVLAVDDSSVDRAVIARILRGSRYRVTAVESATRALELLALGLLPDVSMIITDYWMPGMTGYELLKRVKESATLRGIPVVIMSSENVPTRITRCLEEGAEGFLLKPVRPADVSRLCSRIR

SEQ ID NO: 7164 - protein, 194 aa, Triticum aestivum
  unsure (1)..(194): unsure at all Xaa locations
VIGMDVTASEFFRAGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKNGAPCRFERLAKYNQLLRIXEELGSKAKFAGRNFRNPLAK

SEQ ID NO: 7165 - protein, 101 aa, Triticum aestivum
  unsure (1)..(101): unsure at all Xaa locations
MAPTVMASSATSVAPFQGLKSTAGLPVSRRSNGASLGSVSNGGRIRCMQVWPIEGIKKFETLSYLPPLSTXALLKQVDYLIXRXKWVPCLEVQAKVGFIFR

SEQ ID NO: 7166 - protein, 165 aa, Amorphophallus albus
GTADAVRQYLWLFEEHNVMEFLVLAGDHLYRMDYERFIQAHRETDADITVAALPMDEKRATAFGLMKIDEEGRIIEFAEKPKGEQLKAMKVDTTILGLDDERAREMPYIASMGIYVVSKDIMLELLREKFPGANDFGSEVMPGATSIGMRVQAYLYDGYWEDIGT

SEQ ID NO: 7167 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 7168 - protein, 126 aa, Zea mays
  unsure (1)..(126): unsure at all Xaa locations
ILNPVESFXNIVADYPTVECTSSVLQALVLFGDFNSKYRSKEIKENVDKAAIFIESNQNKDGSWYGTWGICFIYGTLHAINGLVAAGRNYENNICIRKACEFLLSIQLKTGGWAESYRSCERQGDP

SEQ ID NO: 7169 - protein, 572 aa, Geobacillus stearothermophilus
MAKMNVEEQTKTKMSGSMMLIEALKAEQVEVIFGYPGGAVLPLYDELYKAGVFHVLTRHEQGAIHAAEGYARISGKPGFVIATSGPGATNIVTGLTDAMMDSLPLVVFTGQVATSVIGSDAFQEADVVGITMPITKHNYQVRDISELPKIIKEAFHIATTGRPGPVLIDIPKDITTAEGEFDYDEEVCLPGYQPTTQPNHWQIRRLVEAVSQSKRPVILAGAGVLHADAANELRQYAEQQNIPVVHTLLGLGGFPADHPLFLGMAGMHGTYTANMALYECDLLINIGARFADRVTGNLKYFAPKATVAHIDIDPAEIGKNVPTKIPIVSDAKAALQELIAQQGKPADNAAWLEQLNEWKRRFPLHYEPEAGTIKPQKLIEMIYELTNGEAIVTTDVGQHQMWAAQYYKFNRPNRWVTSGGLGTMGFGLPAAIGAQLADRSATVVSIVGDGGFQMTLQELSVIRELGLPIKIVIVNNQALGMVRQWQELFYEKRYSHSLIPNHPDFVKLAEPYGIPGLRAKTEAESAEVLKQAFAMDGPVLLDFHVRADENVYPMVSPGKGLHEMVGVKACEE

SEQ ID NO: 7170 - protein, 312 aa, Yersinia pestis CO92
MKVAVLGAAGGIGQALALLLKTQLPSGSDLSLYDIAPVTPGVAVDLSHIPTAVNIKGFSGEDATPALQGADIVLISAGVARKPGMDRSDLFNVNAGIVRNLVEQIARTCPNALIGIITNPVNTTVAIAAEVLKKAGVYDKNKLFGITTLDTIRSNTFVAELKGKQPQDIEVPVIGGHSGVTILPLLSQIPGVSFTEQEVADLTKRIQNAGTEVVEAKAGGGSATLSMGQAAARFGLSLVRALQGESNVVECSYVEGDGKYARFFAQPILLGKNGVAERKDIGKLSAFEQQALENMLDVLHKDIELGEKFVNQ

SEQ ID NO: 7171 - protein, 253 aa, Oryza sativa
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 7172 - protein, 293 aa, Nostoc sp. PCC 7120
MQINKVRKAVIPAAGFGTRLFPATKVVKKELFPIIDQDGRAKPVILAIVEEAISAGITEVGIVVQPDDIGIFADLFKNPPAPELLQKLSPQNQEYSQYLQDLGQKVVLLTQSEQEGYGHAVFCAKDWVGNEPFLLMLGDHVYKSDIKKSCAQQVVEIYAQVHQSVVGLTTMPAAIINKAGCIAGVWQEFNSILELTQLAEKPNLDYAREHLRVEGMAEDEFLCVFGLYVLTPKIFDFLADSINQNLRDRGEFQLTNCLDKLCQAEGMTGYVVKGKCFDTGLPNTYRQSLIDFI

SEQ ID NO: 7173 - protein, 581 aa, Oryza sativa
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDQKKLEEAIKFANACGAITATKKGAIPSLPTEVEVLKLMEMLEAWKYCDAVMLLLLYMMQKLPWCLVWYEVDATSHVFGWKPEAAWPREPARVPEPRHSIRRASRCEPRARAVVADRPVAAAVSLCTRLSPVSPLRSKPPRRHRRRHRPAPPLRAQAAKGRRQHPSSLCRVAPAHLLLFPESAKGQAPFLPLLFPFFLLAGVILPVAALAATAERQLAPLTAQVGSQTDIAAHLNPSLPFPSSSIRLRAIAAAPVLCLASAVLRRAPGEPVRSRTRKGTSAALSSSSSPARGRRDYSRAVGLSSQRPVPHGATSAPAQPRSGRADPGQSLPVRAFHREP

SEQ ID NO: 7174 - protein, 666 aa, Neurospora crassa
MDGSLMAALPQGQDVIRVISTGGVTKVVKIADCNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLNQYGALPESLVRSFVRQILQGLSYLHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 7175 - protein, 433 aa, Borrelia burgdorferi
MGFHIYEIKARQIIDSRGNPTVEADVILEDGTYGRAAVPSGASTGINEAVELRDGDKSVYMGKGVLKAIENIKNIIAPELEGMSALNQVAIDRKMLELDGTPTKEKLGANAILAVSMATAKAAAKYLGLRPYQYLGAYKANILPTPMCNIINGGAHSDNSVDFQEFMIMPIGAKTFSEAIRMAAEVFHTLKGILSGKGYATSVGDEGGFAPNLKSNEEACEVIIEAIKKAGYEPGKDIAIALDPATSELYDPKTKKYVLKWSTKEKLTSEQMVEYWAKWVEKYPIISIEDGMAEEDWDGWKKLTDKIGNKIQLVGDDLFVTNTSFLKKGIEMGVANSILIKVNQIGTLTETFEAVEMAKKAGYTAIVSHRSGETEDTTIADLVVALGTGQTKTGSLSRTDRIAKYNQLIRIEEELETTAEYHGKSVFYSIKQK

SEQ ID NO: 7176 - protein, 757 aa, Centella asiatica
MWKLKVAEGGNPWLRTVNNHVGRQIWEFDPKLGSPEELAEIEKARENFHNHRFEKQHSSDLLMRLQFANENPRHEVLPQVKVKDIGDISEDKVTITLKRALSFYSTLQANDGHWAGDYGGPMFLMPGLVITLSITEALNAILSKEHKREICRYLYNHQNRDGGWGLHIEGPSTMFGSVLNYVTLRLLGEGTKDGQGAMEKGRQWILDHGGATAITSWGRMWLSVLGVFEWSGNNPLPPEIWLFPYNLPFHPGRMWCHCRMVYLPMSYLYGKRFVGPITPTVLSLRKELFTVPYHEIDWNQARNLCAKEDLYYPHPLVQDILWASIDKVLEPILMRWPGKKLREKALRTVMEHIHYEDENTRYICIGPVNKVLNMLCCWAEDPNSEAFKLHLPRLYDFLWLAEDGMKMQGYNGSQLWDTAFAVQAIISTSLTEYCGPTLRKAHTFMKDSQVLDDCPGDLDFWYRHISKGAWPFSTADHGWPISDCTAEGFKAVLLLSKFPAELVGEPLDAKRLYDAVNVILSLQNSDGGYATYELTRSYRWLELINPAETFGDIVIDYPYAECTSAAIQALSAFKKLYPGHRREEIQCSIEKAADFIEKIQASDGSWYGSWGVCFTYGTWFGVKGLISAGRTFSNCSSIRKACYFLLSKQLASGGWGESYLSCQNKVYTNLEGERSHVVNTGWAMLALIEAGQAERDATPLHHAAKLLINSQMENGDFPQEEIMGVFNKNCMITYAAYRNIFPIWALGDYRCRVLLAP

SEQ ID NO: 7177 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 7178 - protein, 774 aa, Brucella suis 1330
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDSRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAKKMRQAAAILAEKAPDLESDGEMHGDAALSQTLRDRVFPSSRLKGEANLLVFPNLDAANITLNVVKAVTDALHVGPILLGATRPAHILTPSVTSRGVVNMTALAVVEALQKNASNRRQK

SEQ ID NO: 7179 - protein, 235 aa, Burkholderia fungorum
MGRKEKPVSPETSGIGIKPVSREGTERLVRKAIQYAIDHDRRSVTLVHKGNIMKFTEGAFRDYGYALAQKEFAAELIDGGPWMKIKNPKTGGDVVLKDVIADAFLQQILLRPAEYDVIATLNLNGDYVSDALAAQVGGIGIAPGANMSDSVAMFEATHGTAPKYAGKDYVNPGSEILSAEMMLRHLGWTEAADLIIKSMEKSILQKRVTYDFARLMEGATQVSCSGFGQVLIENL

SEQ ID NO: 7180 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 7181 - protein, 180 aa, Zea mays
CSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKVWRSFFFFFFFYL

SEQ ID NO: 7182 - protein, 368 aa, Methanosarcina mazei Goe1
MLMSLSRRELIKKEIFDIEEYVPGRSIEEIASTYGLKPESIIKLGSNENPLGPSPKAVKALIEAAPGANIYPSADAHELREALSKYTGFPVSNIVASGPGMDGLLDGLCRIIIEKGDEVIVPIPTFSYYELPARACGAEPVFIRRNQDFSLNPEKILEAVSPRTKIIFLCSPNNPSGNLLPEADLRKIIENTDALVFVDEAYVEFADRNLAALVNEYDNVAVGRTFSKVFGLAGLRLGYGIMPEWLTKEYLRAATPFSVSLPALRAGLAALSDTEYLNKSINLAREGREYLKEKIPFKVYPSQANFVLVDVSPLKAKKVTESLLKKGIIVRPCDSFREAGDSFIRVTVGTPEQNEKVVRAFEISKSEV

SEQ ID NO: 7183 - protein, 363 aa, Aspergillus niger
MPAYNIVVFAGDHWGPEVTAEAIKVLRVIEKSRDDITLNLQDHLLGGASIDATANPLTDEALAAAKNADAVLLGAIGGPKWGTGAVRPEQGLLNVRKEMGTFGNLRPCNFAAPSLVEHSPLKASVCEGVDFNIIRELTGGIYFGDRKKMTAAATMDTEPYSRAEIERITPRAHLALQHNPPLPVWSLDKANVLATSRLWRKTVTEIMAKEFPQLKIEHQLIDSAAMIMVKNPRQLNGIIVTSNLFGDIISDEASVIPGSLGLLPSASLSGIPDGKGRVNGIYEPIHGSAPDIAGKGIVNPVAAILSVAMMMQYSFGRFDEARAIEAAVRNVLESGVRTGDIGGKATTSEVGDAVAAELEKLLK

SEQ ID NO: 7184 - protein, 561 aa, Zea mays; identical to SEQ ID NO: 5437

SEQ ID NO: 7185 - protein, 215 aa, Zea mays
MSAQDPLSSTNPSSVTNNTQDASGRQPSSAAAGSSELSSAKISLRKSLRSFPDFPIPGINFVDIMPLFADPTAHATLVEALELQIAEAFPTKPDIIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 7186 - protein, 493 aa, Zea mays
  unsure (1)..(493): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMXRGFGVNTYTLINRDGKPHLVKFHWKPTCGVKCLLDDEAVTVGGTCHSHATKDLYDSIAAENYPEWKLYIQTIDLDHEDKFDFDPLDVTKTWPEDIIPLQPVGRMVLNKNVDNFFAENEQIAFCPAIIVPGIHYSDVKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHHTIWISYWSQCDAALGQKLASRLNLKPNM

SEQ ID NO: 7187 - protein, 146 aa, Triticum aestivum
  unsure (1)..(146): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEXSSKVGFIFREHNASPGVLRWPGTGTMWECLLFGIAPDANASDTRWEGGPETLDAL

SEQ ID NO: 7188 - protein, 245 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSVILSQSLQPLNIGGPYHPSGIEEGAALGPPQHRNATLFPSWMLSHLQE

SEQ ID NO: 7189 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 7190 - protein, 174 aa, Glycine max
MADKEEESAMPRDAKIVKSLLKSMGVEDYEPRVIHKFLELWYRYVVDVLTDAQVYSEHAGKSAIDCDDVKLAIQSKVNFSFSQPPPREVLLELAQNRNKIPLPKTIAGPGIPLPPDQDTLISPNYQFAIPNKRPAEPLEETEDEEATIPNPSQEDVQPNPHQRVSFPLPKRQKD

SEQ ID NO: 7191 - protein, 159 aa, Buchnera aphidicola
MANILLLDNVDSFTYNLVDQLRTYNHTVVIYRNTVDIKIILQFLTQWINPILVLSPGPGTPRDAGCMLHLIKAVKGKIPIVGICLGHQAIIEAYGGSIKYTDEIFHGKVSVINHDGLKMFKGVPQSLSVARYHSLVCNQLPPCFIVNASIKNVVMSIRH

SEQ ID NO: 7192 - protein, 448 aa, Capreolia implexa
LALFRVTPQPGVDPVEASAAVAGESSTATWTVVWTDLLTACDLYRAKAYKVDAVPNASDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKELGTVIVMIDLVIGYTAIQTMAIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGIDVVLQFGGGTIGHPDGIQAGATANRVALEAIVIARNEGRDYVAEGPQILRDAAKTCGPLQTALDLWKDITFNYTSTDTADFVETPTANV

SEQ ID NO: 7193 - protein, 470 aa, Myriogramme livida
GVIPYAKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKALGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 7194 - protein, 425 aa, Zea mays
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQASFCVGYLIFISNTMAHLYPIAIGAQSPASPLLTAKALFIWAMLPFQLGLNSIRTLTLLAPLSIFADVVDLGAMGVVLGQDASVWLADRPPVFAFAGPAQLLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVLVGLLAMLVPNFADFLSLVGSSVCVVLGFVLPAVFHLKVFGTEIGWAGLVADVAIIVTGIALAVSGTWTSLVQIFSSSDL

SEQ ID NO: 7195 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 7196 - protein, 469 aa, Escherichia coli O157:H7 EDL933
  unsure (1)..(469): unsure at all Xaa locations
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEXATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 7197 - protein, 427 aa, Coxiella burnetii
MTELTGVSIVTYQHIKVPSQGEKITVNKAVLEVPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAMKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 7198 - protein, 849 aa, Trichodesmium erythraeum IMS101
MNKPVNKSVNSTTKTQIQIEDDRTGMSVKTLRRALADNLFYLQGTYESMAKKDDFYRALAYTIRDRLLQRFLSTIRTYNEKDVKVVYYLSAEFLMGRHLGNSLINLGIYEEIRQAVSESGLNLDELLEQEDDPGLGNGGLGRLAACFLDSLATLEIPAIGHGIRYEFGIFTQNIQDGWQAEIPDKWLRFGNPWEIARPGEQVEVKFGGTTEGYHDEKGNYRVTWVPAQTVVGIPYDTPVPGYKVNTVNPLRLWRAEASVDFKFEEFNSGNYDGAVAEKMSSETISKVLYPNDNTPQGKELRLKQQYFFVSCALQDILRRHLLHNQNLDNLSDKTAIQLNDTHPAVAIVEMMRLFIDEYDIDWDRAWHITQHTFAYTNHTLLPEALERWGITLFGSLLPRHLELIYEINRRFIEQVQTWYPKDKELISRISIIEESPEKAVRMANLATIGSHAVNGVAALHTELLKKGVLQDFYKLFPEKFMNKTNGVTPRRWILLCNPKLSALFSEKLGDSWLRNLDQLKELEKYVDDVEFCKRWRQIKQENKAKLAEYILKHNRIEVDTNSLFDIQVKRIHEYKRQHLDLFHIITLYNRIKQNPKINIQPRTFIFGGKAAPGYYMAKLIIKLTNVVADIVNNDPDVHGRLKVVFLANFNASLGQLIYPAADLSEQISTAGKEASGTGNMKFAMNGAMTIGTFDGANIEIREEVGAENFFLFGLTAEEVFDLKAKGYQPLDYYNTNSELKAVIDRITSSQFSKGHPNLFKPLINSILYNDQYMLLADYQAYIECQEKVSQVFQDPKKWTKMSIYNSVRMGKFSSDRTILEYAKEIWGATPVKINQGKYNQNDAGLKVDN

SEQ ID NO: 7199 - protein, 348 aa, Escherichia coli CFT073
MEFFKKTALAALVMGFSGAALALPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKTVFDTLATAAKNGTAVVRSSRVPTGATTQDAEVDDAKYGFVASGMLNPQKARVLLQLALTQTKDPQQIQQIFNQY

SEQ ID NO: 7200 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 7201 - protein, 183 aa, Methanosarcina acetivorans C2A
MSESSIKIENVVASTKLAEEFDLTVIESEFEGAEYNKQKFPGLVYRVSDPKAAFLVFTSGKVVCTGAKNVADVHTVIGNMAKKLNSIGIKTMENPQITVQNIVASADLHTILNLNAIAIGLGLENIEYEPEQFPGLVYRIDEPKVVVLIFSSGKLVVTGGKSPEDCERGVEVVRQQLDNMGLL

SEQ ID NO: 7202 - protein, 145 aa, Rhodospirillum rubrum
MEGRFPIPGRSPGNRGGTRGERTSSDTGVTMADQQKSGAEIVLKALADQGVEVIFGYPGGAVLPLYDEIFKQNQIRHVLVRHEQAAVHAAEGYARSTGKTGVVLVTSGPGATNAVTGLTDAMLDSIPVVCLTGQVPTHLIGNDAF

SEQ ID NO: 7203 - protein, 519 aa, Zea mays
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 7204 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 7205 - protein, 373 aa, Physcomitrella patens
MRKTLKKCCCFASLMELCVRASVEGRRAHHLVTLSSLFNKGTQPTIKANKPSVSYGQALQAKKEEDFVIVKTNCQRIPGDGSSTYDAFAVLDGHNGSAAGAFTKENLLNNVVNAVPSGLSRDEWLAALPRAMVAGFVKTDKDWRSKGIFSGTTVTLVIVDGYIVTCACVGDSRCVLDAQGIVTALTIDHRFDTNEEECERVVASGGQVARLHPYGCDIGPLRSWPGGICLSRTIGDVDAGEHIVPVPHVKQIKLSPGGGRLIIASDGVWDALTSEKAAKVCRGEKHPEVAAKNIVKEVIKVQGLRDDTTCLVVDIVPPGRASRSFAPAVRKQMMVMRFLRRTRSKKGSGSGAPMEELFEESSATLSERLRPVT

SEQ ID NO: 7206 - protein, 569 aa, Bradyrhizobium japonicum
MAINNVADLFVATLEQAGVKRIYGIVGDSLNAFTEALRRRGTIEWIHVRHEEVAAFAAAGEAQMTGSLAVCAGSCGPGNLHLINGLFDAHRSRVPVLAIAAQIPSAEIGGGYFQETHPQNLFRECSHYCELVSDASQLPFVIENAIRAAVGLRGVAVIAMPGDVAFRDPPRRALSTARGLALSAPKVVPEANELKALADLLNGAERITLFCGRGCAGAHAPLMQLAEALKSPIVHALGGKEHVEYENPYDVGMTGFIGFSSGYAAMHACDALVMLGTDFPYKQFFPTGCQIAQIDIRPENLGRRQADHRGRSAAAEDQDPAQAYSTMPSRITRRRARGWTRSPGAPPGSKPIHPQYLAKVVSDHASEDAVFTADVGTPTVWAARYLEMNGRRRLIGSFVHGSMANAMPQAIGAQASQPGRQVISLSGDGGFTMLMGDLITLTQMKLPVKVVVFNNGVLGFVALEMKAAGFVDTNVDLQNPDFAAMARAMGIFAKRVEDPGELPGAVKEMLAHNGRALLDVVTAKQELSMPPTITTEQIKGFSLWVLRAVMNGRGGRGARCLAKTNLLPR

SEQ ID NO: 7207 - protein, 304 aa, SYNECHOCOCCUS SP. WH 8102
MHQFLPYAWFQGQCVPFEEARISIATHALHYGTGAFGGMRAIPDPQSSGSMLLFRADRHARRLSRSARLLLTDLSEATILEALTAMLQANKPQQPIYLRPFVYTSDLGIAPRLHDIETDFLIYGLPLGDYLSPDGVSCRISSWTRQEDRSLPLRGKISGAYITSSLAKTEAVQSGFDEALLLNSRGKISEASGMNLFLVRDGQLITPGVDQDILEGITRASVIELAKAMQIPVVERPVDKTELFIADEVFLTGTAAKITPIRQIESTQMNTDRPVMTALKTRLVSITEGRDTAYEHWVTRIPIA

SEQ ID NO: 7208 - protein, 377 aa, Glycine max
MPVTNTTTPTVAEHIKWRRPRNQFNHHQHPISETDPNPQIPSIIQSTRCKSTISSLLLSTFSNNTSSNNDTPTTFNATAHSKKKSNFSASTFRGLGCTAGASQQVSVPAVIRSSADWQGKKTRKKKHKRSSSSSKNKTFHGGVLEGSNPECVDFQDVWCGPGIGFSTDAAAAASVDCVVARKNVSSARGKIDVDKITHRERSSYVGRRTETFTFLDSTDPDIFTPRSASDTYGTATYYRHVRDPSSDGFAEIMMLQGSLLMGGQLNSHDHFKDWRLDVDNMSYEQLLELGERIGHVNTGLKEDEMGRNIRKTRLQFWDDTSKLQVDKECSICQEEYEAGNELGRLNCEHSYHFQCIKQWVAQKNFCPVCKQQVAARH

SEQ ID NO: 7209 - protein, 460 aa, Desmarestia viridis
WDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLRGGLDFLKDDENINSQPFMRWKERFLYCMEGVNRAAAGTGEVKGSYLNVTAATIEQMYERAEYAHAIGSVIVMVDLVIGYTAIQTMAIWARKAEMILHLHRAGNSTYARQKNHGINFRVICKWMRMCGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQAGATANRVALEAMVLARNEGRDYVGEGPEILRNAASTCGPLKAALDLWKDITFEYTSTDTPDFVEVATESK

SEQ ID NO: 7210 - protein, 310 aa, Staphylococcus auricularis
GFGRIGRLAFRRIQNVEGIDVVAVNDLTDDDMLAHLLKYDTMQGRFTSEVEIVEGGFRVNGQEVKSFDEPDPSKLPWKDLDIDVVLECTGLFTDKEKAEAHIDAGAKKVLISAPAKGDVKTVVYNTNHDTLDGTETVVSGASCTTNSLAPVAKVLNDEFGLVEGFMTTIHAYTGDQNTQDAPHKKGDKRRARAAAQNIIPNSTGAAKAIGKVIPEIDGKLDGGAQRVPVATGSLTELTVVLEKDVSIEDVNNAMKNASTESFGYTDDEIVSSDVIGMTYGSLFDATQTRVMTVGDHQLIKVAAWYDNEMS

SEQ ID NO: 7211 - protein, 439 aa, Schizosaccharomyces pombe
MAIQKVFARQIYALGGNPTVEVDLTTETGIHRAIVPSGASTGIWEALEMRDGDKTKWGGKGVLKAVGNVNNIIAPAVVKANLDVTDQKAADEFLLKLDGTENKSKLGANAILGVSMAICRAGAAQKKLPLWKYIAENFGTKGPYVLPVPSFNVLNGGSHAGGDLAFQEFMILPTGAPSFSEAMRWGAETYQTLKSIAKKRYGSSAGNVGDEGGIAPDLQTPQEALDLIVEAINKAGYEGKIKIGLDVTSSEFYVDGKYDLDIKAAKPKPENKLTYQQLTDLYVELSKKYPIVSIEDPFDQDDWSAWTHMKAETDFQIVGDDLTVTNVKRLRTAIDKKCANALLLKVNQIGSVTESLNVVRMSYEAGWGVMVSHRSGGTADTFISHLTVGIGAGQLKSGAPCRSERLAKYNELLRIEEELGSRGVYAGAHAGKYIKAAKF

SEQ ID NO: 7212 - protein, 426 aa, Chlamydophila pneumoniae J138
MLPLIIFVLLCGFYTSWNIGANDVANAVGPSVGSGVLTLRQAVVIAAIFEFFGALLLGDRVAGTIESSIVSVTNPMIASGDYMYGMTAALLATGVWLQLASFFGVPVSTTHSIVGAVIGFGLVLGKGTIIYWNSVGIILISWILSPFMGGCVAYLIFSFIRRHIFYKNDPVLAMVRVAPFLAALVIMTLGTVMISGGVILKVSSTPWAVSGVLVCGLLSYIITFYYVHTKHCSYISDTPKKGSLTYRLKERGGNYGRKYLVVERIFAYLQIIVACFMAFAHGSNDVANAIAPVAGVLRQAYPASYTSYTLIRLMAFGGIGSVIGLAIWGWRVIETVGCKITELTPSRGFSVGMGSALTIALASILGLPISTTHVVVGAVLGIGLARGIRAINLNIIKDIVLSWFITLPAGALLSILFFFALRALFH

SEQ ID NO: 7213 - protein, 181 aa, Hordeum vulgare
KYPYIAGMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDMN

SEQ ID NO: 7214 - protein, 246 aa, Lycopersicon esculentum
MGRGRVELKRIENKINRQVTFAKRRNGLLKKAYELSVLCDAEVALLVFSNRGKLYEFCSTNNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 7215 - protein, 98 aa, Buchnera aphidicola
  unsure (1)..(98): unsure at all Xaa locations
LPSASLNDSNXGLYEPAGGSAPDIAGKNIXNPIAQILSIAMLVRYTMKLPIISDQIESAVIDTLKKGYRTLDIANDKEKCESTNDIGDIISYILKKRI

SEQ ID NO: 7216 - protein, 320 aa, Streptococcus agalactiae 2603V/R
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 7217 - protein, 157 aa, Candida albicans
LLSLDGTPNKSKLGANAILGVSLAAANAAAAAQGIPLYKHIANISNAKKGKFVLPVPFQNVLNGGSHAGGALAFQEFMIAPTGVSTFSEALRIGSEVYHNLKSLTKKKYGQSAGKLGDEGGVAPDIKTPKEALDLIMDAIDKAGYKGKVGIAMDVAL

SEQ ID NO: 7218 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDAKTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHNDHYTQAGDLYRLMSEDERTRLVENIVNAMKPVEKEEIKLRQIEHFYKADPEYGKRVAEGLGLPIKKDS

SEQ ID NO: 7219 - protein, 472 aa, Petroglossum pacificum
ESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEEMYERAEFAKELGSIIIMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESVVIARNEGRDYVAEGPQILQDAAKTCGPLQTALDLWKDITFNYTSTDTADFVETPTANV

SEQ ID NO: 7220 - protein, 439 aa, Oryza sativa
MEVQGEVDGSGVPLAVLLKRELCNQKVERPDMLFGEASKSKKGEDFTFLLPKCSRRPGQAQADGEDAGGAGDDDTISVFAIFDGHNGSAAAIYTRENLLNNVLAAIPPNLTSEEWTTALPRALVAGFVKTDKEFQTKAARSGTTVTFVIIDGWVVTVASVGDSRCILESAEGSVYFLSADHRLDTNEEEVERVTASGGDVGRINIAGGAGIGPLRCWPGGLCLSRSIGDIDVGEFIVPVPHVKQVKLSNAGGRLVIASDGVWDALRFQEALNYTRGLPAEAAASRIVKESVSSKGLRDDTTCIVVDILPPEKLSPPLKKHGKGGIKALFRRRPSDELTEDQMDRGCLEPDVVEEIYEEGSAMLAQRLKINYPTGNMFKLHDCAVCQLVMKPGEGISVHGSIPRNSRVDPWGGPFLCSSCQLKKEAMEGKQHLTSMNAFI

SEQ ID NO: 7221 - protein, 479 aa, Streptomyces avermitilis MA-4680
MSTELRRLRNHIDGEFRDAADGRTTEVVNPATGEAYATAPLSGQADVDAAMAAAAAAFPAWRDQTPAERQKALLKIADAFEERAEELIAAEVENTGKPIGLTRSEEIPPMVDQIRFFAGAARMLEGRSAGEYMEGMTSIIRREPIGVCAQVAPWNYPMMMAVWKFAPALAAGNTVVLKPSDTTPASTVLIADIIGSILPKGVFNVICGDRDTGRAMVEHPTPAMASITGSVRAGMSVAESAAKDVKRVHLELGGKAPVVVFEDTDIPKAVEDISVAGFFNAGQDCTAATRVLVQESIHDEFVAALAKAAADTKTGQPDDEDVLYGPLNNPNQLKQVAGFVERLPAHAKVEAGGHQVGEKGYFYAPTVVSGLKQDDEIIQNEVFGPVITVQSFTDEAQAIEWANGVDYALASSVWTKDHGRAMRLSKSLDFGCVWINTHIPLVAEMPHGGFKKSGYGKDLSAYGFDDYTRIKHVMTSLDS

SEQ ID NO: 7222 - protein, 829 aa, ASPERGILLUS NIDULANS FGSC A4
MLLRLPPSLHYPITVTSLLKQPGDEVERDEAIFWYAYQTIVTEGDGWGNKVDVKRTFPTRFESTVDGNIVQWKISKGDVIDGPVDVVEIDEPCAHEVQYGGLCAECGKDMTEATYNTEVPGSMRAPIQMTHDNTALTVSEREAIRVEEDAKRRLLANRKLSLVVDLDQTIIHAAVDPTIGEWMADKDNPNHAAVSDVRAFQLVDDGPGMRGCWYYVKLRPGLEEFLENVAEMYELHIYTMGTRSYAQAIANIIDPDRKLFGDRILSRDESGSLSVKNLHRIFPVDTKMVVIIDDRGDVWRWSPNLIKVIPYDFFVGIGDINSSFLPKKQELETPGENQEQNPTPPIQQQVNGLAEKSDATELSTLEQLVTMGGGDNPRLLQEQTEAQDVTILHQVEDRPLLQKQKELDAEDESADSRESGLNESRDSAKPRHHLLIDNDQELIKLSDRLEQVHRKFYEEYDQKRARGLGGRVAALRGERAISKEKDVDLKLVPDVKDILPAIKRRIMGNVHVVHSGLWKLNEDIANIELAQHAKTFGVVFADRITHKTTHLLSAGKRTAKFQEAMQRPKIKIVRKEWLVDSLLQWKHLDEGPYLVPTHPNEQRSSKEVAESSWLSSSDEASGDSFTDTEDASELNDEILKSAGINDLGFDQDEEAAVHEELKEFLGSDDESESDSEISWMERNELPPTSNPDKKRKREDGTDNDNDENNSDTQGSGEVAGSRLSQRIKRSYERSTGLKEVASATSGENGSNTDTGTATGTDTDTAEADDVPDVAFPETEEEGAASRNPDSSYPQDPAEEEDELEREMLAAFEEGGYDSNAEKAIGEDKG

SEQ ID NO: 7223 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIICSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGQEFVNK

SEQ ID NO: 7224 - protein, 537 aa, Neurospora crassa
MTTNGINGTNGAHANGDGHINTTPKTFVVNSPNVVYTDEEIRSKYTYRTTLCTVEGDNYVAVPKETVYDFKVDRKVPKTGLMLVGWGGNNGTTVTAGILANKHKYSWATKEGTQEANYYGSVIMGSTIKLGIDAKGKDVNVPFHNVLPMVHPNDLVIGGWDISGMPLDKAMDRAKVLQPTMKELVREEMSKMVPLPSIYYPDFIAANQENRADNVLPGSKASMEHVEQIRKDIREFKAANGLDKIIVLWTANTERYADLIDGVNDTADNLLKSIEAGHEEVSPSTIFAVACILESTPFINGSPQNTFVPGAIELAERHGAFIGGDDFKSGQTKMKSALTDFLINAGIKLTSIASYNHLGNNDGYNLSSQKQFRSKEISKSNVVDDMVAANSVLYKEGEHPDHTVVIKYMPAVGDDKRALDEYYAEIFCGGHQTISLFNVCEDSLLASPLIIDLVVITEIMTRIQWKAAEAGAAAEKDFKHFHSVLSVLSYMLKAPLTPPGTPVVNALAKQRAALTNIFRACVGLEPESDMTLEHKLF

SEQ ID NO: 7225 - protein, 148 aa, Glycine max
  unsure (1)..(148): unsure at all Xaa locations
IKYEKKALEVVGKRLKKNSVSLDVVNFGDDDDXDKPLKLEALLSSVNNNDGSHIVHVPSGPNALSDVLLSTPVFTGDEGASGYVSAAAAAAAAGGDFDFGVDPNIDPELALALRVSMEEERARQEAAAKKAADEAGQKXQDGXSAXXS

SEQ ID NO: 7226 - protein, 56 aa, Zea mays
SKALPGLMYRMKQPKIVLLIFVFGKIVLTRAKVSNRFYVAFEIIYPVLIKFIKVRQ

SEQ ID NO: 7227 - protein, 292 aa, Salmonella enterica subsp. enterica serovar Anatum
MKTRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGNDDCALVLGDNIFYGHDLPKLMEAAVNKESGATVFAYHVNDPERYGVVEFDQSGTAVSLEEKPLQPKSNYAVTGLYFYDNSVVEMAKNLKPSARGELEITDINRIYMEQGRLSVAMMGRGYAWLDTGTHQSLIEASNFIATIEERQGLKVSCPEEIAYRKGFIDAEQIKNLAKPLSKNAYGQYLLNMIKGY

SEQ ID NO: 7228 - protein, 254 aa, Bartonella henselae
MSPNIRPFIAGNWKMNGTGESLGELRAIAAGISSDLGRLFEALICVPATLLSRAFDILGGENILLGGQNCHFDDYGPYTGDISAFMLKEAGASHVIIGHSERRTVYQESDAIVRAKVQAAWRAGLVALICVGETLEERKSNKVLDVLTRQLEGSLPDGATAENIIIAYEPVWAVGTGNTATSADVAEVHAFIHHKMHSRFGDEGAKIRLLYGGSVKPSNAFELLSTAHVNGALIGGASLKAIDFLTICDVYRKL

SEQ ID NO: 7229 - protein, 131 aa, Synechococcus sp. PCC 7942
MVKLGLGSPTQFRRSTRTMAGKGFGFSLGKMKELADAFKKAQQVQEGAKQVQEDLNNMEIEGQAQGGLVKVWVSGNQEPLRAEIAPEALNEGAEVLSELVAAAMKDAYQKSTAAMKEKMEALTAGLGIPGL

SEQ ID NO: 7230 - protein, 235 aa, Glycine max
MRVVCCSNSGVSATLPSFPCPRFPPLIAISSIRFLNSTPLRSTASPRQVTRMASKNAQQDTRLARIASAIRVIPDFPKPGILFQDITTLLLDTKAFKDTVDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRDRLGDKSLFVLIKGGA

SEQ ID NO: 7231 - protein, 362 aa, Sorghum bicolor
MGSTAEDVAAVADEEACMYAMQLASSSILPMTLKNALELGLLEVLQKDAGKALAAEEVVARLPVAPTNPAAADMVDRMLRLLASYDVVRCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGINFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 7232 - protein, 521 aa, Zea mays
  unsure (1)..(521): unsure at all Xaa locations
MGTVGGGELPVADPAAADADRARLQQLGYKQELKRGLSVVSNFAFSFAIISVLTGVTTTYNTGLRYGGPASMTLGWLVVATFNGCVALSMAEICSAYPTSGGLYYWSAKLAGNEWAPLASWVTGWFNIVGQWACTTSVDFSLAQLIQVIILLSTGGANGGGYLASKYVVLAIYTAILVVHGLINSLHIQWLSWFGQLGALWNVAGVFVLVILVPSVAKERASAEFVFTHLNTDNGMGIHSKAYILAVGLLMSQYSSIGYDTSAHMTEETKKAEWSGPMGIVVSVSLLTACSGRVYLLALTSGTADDVPSRWDPTKAPGGNAIAQALYGHFXRRFGSGAGAXLCRAHLAVAIFLCGVASVTSNSRMGYAFSRTGAMPLPQVCXRGHKQGVPFNVRRLSVSVAFVMXALTSLGSQVAFQAMVSITPLGMYIAXRLPIFLRVTTARKLLRTGPFPSGRPLKPVGSVAVLWVALVTVLFCLPVAYPVAKDTFNYTPVAVGGVLVLSLVAWVLHARFWFRGPITNV

SEQ ID NO: 7233 - protein, 447 aa, ASPERGILLUS NIDULANS FGSC A4
MASRTTAFDLSKCARKNILKLQPYRCAREYVRPLTLPPQSAPKLINRTSDYKDDGTNVLLDANENAYGPGLALNSGGALQESAANGHSTGSSKPEIDLLGLNRYPDPHQHPLKQLFCNIRNTHTHTDKTITPENLFVGVGSDEAIDALLRAFCVPGKDKILTCPPTYGMYSVSADVNDVEIVKVPLDTDNGFALQPEKINAALSADPTIKLVYICSPGNPTATLVSKSDIQKVLEHPTWNGVVVLDEAYIDFAPEGSSLAEWVAEWPNLVVMQTLSKAFGLAGIRLGVAFTSPEIATLLNSLKAPYNISSPTSALAMAALGNPKNLEVMRSYRSKIIAQRDRILKELPSIPGIGRFRGGTESNFLLVEILDKPADQGGKPSNPVALATYEAMAEKRGVVVRFRGKELGCEGCLRITVGTEDEVTRFLEEIRHVLGGLLNGNEIASRK

SEQ ID NO: 7234 - protein, 295 aa, Eremothecium gossypii
MSDLTNYKRLEKVGEGTYGVVYKAVDLRHGQRIVALKKIRLESEDEGVPSTAIREISLLKELKDDNIVRLYDIVHSDAHKLYLVFEFLELDLKRYMESVPKDQPLGDKIIKKFMMQLCKGIAYCHAHRIIHRDLKPQNLLINRNGNLKLGDFGLARAFGVPLRAYTHEIVTLWYRAPEVLLGGKQYSTGVDVWSIGCIFAEMCNRKPLFSGDSEIDQIFKIFRLLGTPNESVWPDIVYLPDFKPTFPKWQRRDLAQVVPSLNEHGLDLLDKLVTYDPIHRISAKRAVTHPYFKDE

SEQ ID NO: 7235 - protein, 268 aa, Datura stramonium
MAGREIGGGDRRWSLRGMTALVTGGTRGIGYAIVEELANFGAEVYTCSRSQNDLDECLEKWRRKGFKVSGPVCDVSSISQRQTLMESVTSSFNGKLNILINNAGTTIPKEATNFTAEDYSIIMGTNFEASYNLCQLAHPLLKASGNASIVFNSSAAGVIAVPLSSIYAASKGAINQVTKSLACEWAKDSIRVNAVAPWIINTPIIEAACQVPSQKKNIESLIGRAPMKRAGEPSEVSSLVTYLCLPTASYITGQIICVDGGYTVNGFI

SEQ ID NO: 7236 - protein, 405 aa, Vaucheria litorea
MLVHSLILLLAAGALHVESFVSTHSALRTSTFTNNAQSLNKAASKLQALEMKLGDPDEPVVIIGVAADSGCGKSTFMRRLTNIFGGSSVGPLGGGFGNGGWETNTLVSDLTTVICLDDYHLNDRNGRKVSGRTALHTDEQKFDLMTEQLSALKRGESVMKPIYNHVNGTLDTPEEVKPTPIVIIEGLHPFVDERVRDLLDFTIYLDISDEIKFAWKIQRDMMERGHSLESIQASIEARKPDFDAYIAPQRAQADVVLQVLPTKLVPEDKEGKILRTRLIQKENVKNFETAYLFDEGSTINWIPCGRKLTCSFPGIKFAYGPDTYFDNEVSVLEMDGQFDNLQELIYVEGFLSNTGTKFYGELTQNILKLSDSPGSNNGTGFLQTVIALKLREIYEKITTSQAEAA

SEQ ID NO: 7237 - protein, 238 aa, Nicotiana tabacum
VKPMEEIIPKNTNTITTICSSKPSTHIERKIRPHQKDQALNCPRCNSTNTKFCYYNNYSLSQPRYFCKTCKRYWTEGGSLRSIPIGGGSRKSKKSSSTNCSSSNTVLREFSKNVVAPVLDPPKMEGSQDLNLGFSCDFKTISELIQVPNNSFMPMPISDPNSVYSSLNFSLDYGLGISGDYENNLQDVQDSTTSGRLLFPFEDLKQISNTSIDCAEENRDGESNGYWNAVLGGNGGSW

SEQ ID NO: 7238 - protein, 432 aa, Synechocystis sp. PCC 6803 [sequence omitted]

SEQ ID NO: 7239 - protein, 402 aa, GIBBERELLA ZEAE PH-1
MTSHGIARTARSRTEEQRKQDLVKIEKYRNLEDQIREKISDNYYGPETFQFTSKLLRLNPEYYTIWNARRRCLISGLLSKPSDGSPPSKASQNIIVTDIPTTSSAVSSPSSSTETPPRPNPLTTGKTGITTDSDADAEVIRAELAFTVPLLMEFPKCYWIWNYRLWILDRAIERLDVSIARRIWEEELGLVSKMLAKDRRNFHAWGYRRHVVAQLESPLLNGQSLVEPEFLYTTKKIHDDLSNFSAWHNRSQLITRLLNERNADDESRKAFLDQELDLVDEGLNVGPEDESLWYYHQFLVLNLADSTSSRQIAPNLTTDDRKSYLEREMTNIKDLLEDYRNVKRIYEALAEYAMTLAQLSGQPLGSEEQIEVASWLSHLRKLDPKRNGRWHDLEKKLGLLHS

SEQ ID NO: 7240 - protein, 566 aa, Campylobacter jejuni subsp. jejuni NCTC 11168
MKELSGSAMICEALKEENVKIVFGYPGGAALNIYDEIYNQKYFKHILVRHEQAALHAADAYARMSGEVGVAIVTSGPGFTNTITGLATAYSDSIPLVLISGQVANSLIGTDAFQEIDAVGISRPCVKHNYLVTCIEEFPRILKEAFYIARSGRPGPVHIDVPKDVSATLGLWEYSKEISMKTYKPVYKGNSKQIKKFAELLKEAKRPLFYLGGGCISSNASEQIRELIKFTKIPAVETLMALGTLRSDDVFNLKMAGMHGSYAANMALSECDLLVSVGARFDDRITGKTSEFAKHATIVHVDIDPSSISKIINAHYPIVGDIKEVLKELLEELKKENFNTTFKEWHETLKRYNELYPLSYEDSNEILKPQWVIEECAKMAPDARIITDVGQHQMWVAQFYPFNYPRQLATSGGQGTMGYSLPAALGAKLAVGEEVVINFVGDGSVLMNIQELMTAYEYGIKAINIILNNAFLGMVRQWQSMFYKEHFSQTDLSTQPDFIKIAQGFGCEGYEISNKEEFIQAFSQALKSDKTSLLNVKIDRFEDVLPMVPAGGAIYNMILPKAKDRQ

SEQ ID NO: 7241 - protein, 113 aa, Synechococcus sp. PCC 7942
MAGKGFGFSLGKMKELADAFKKAQQVQEGAKQVQEDLNNMEIEGQAQGGLVKVWVSGNQEPLRAEIAPEALNEGAEVLSELVAAAMKDAYQKSTAAMKEKMEALTAGLGIPGL

SEQ ID NO: 7242 - protein, 139 aa, Pectobacterium carotovorum subsp. carotovorum
NAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAAR

SEQ ID NO: 7243 - protein, 277 aa, Populus tremula
ETAAFAALRKPVDVAFGRNYVPTWAFDHIKYFNGGNEIQLHLDKYTGTGFQSKGSYLFGHFSMQMKLVPGDSAGTVTAFYLSSQNSEHDEIDFEFLGNRTGQPYILQTNVFTGGKGDREQRIYLWFDPTKEFHYYSVLWNMYMIVFLVDDVPIRVFKNCKDLGVKFPFNQPMKIYSSLWNADDWATRGGLEKTDWSKAPFIASYRSFHIDGCEASVEAKFCATQGARWWDQKEFQDLDAFQYRRLSWVRQKYTIYNYCTDRSRYPSMPPECKRDRDI

SEQ ID NO: 7244 - protein, 248 aa, Helianthus annuus
MGRGKVQLRRIENKINRQVTFSKRRGGLLKKAHEISVLCDAEVALIVFSNKGKLFEFSTDSCMDSILERYERYSYTERQLVAADATPRSWTLEYNKLKSRAELLQRNHRHYMGEDIESLSLKEIQNLEQQLDTGLKNIRTRKNQLLHESISELQKKGKAIQEQNTTLTKKIKEKEKDKTIPQNTQWEMHNYVDHDTTFLMPPPPPALNMGGDYNHGGGGSSEGADGRTNELDLSLQPIYSCHMRCFPS

SEQ ID NO: 7245 - protein, 488 aa, Chordaria chordaeformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENFNSQPFMPWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 7246 - protein, 578 aa, Hordeum vulgare subsp. vulgare
MGGGNGIVDGFRRLFHRRTPSGSVLGSSNQSSAGEDSSELEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIEIWSIGCIFAELLTGRPLFPGKNVVHQLDIITDLLGTPSSETLSRIRNEKARRYLRYMRKKHPVPLTQKFPNADPLAVRLLGRLLAFDPKDRPSAEEALADPYFASLANVEREPSRHPISKLEFEFERRKVTKDDVRELIYREILEYRPQMLEEYMKGGDQISFLYPSGVDRFKRQFAHLEEHYSKGERGSPLQRKHASLPRQRVGASNDSNNEQHISDQEMSAEPDAHGAVSPQKPQDAPGVGQNGLSPTSLSSRTYLKSASISASKCVVVNPNKQPEYDDAISEETEGAVDGLSEKVSKMHA

SEQ ID NO: 7247 - protein, 145 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 7248 - protein, 489 aa, Dechloromonas sp. RCB
MSQPQRIHHFINGEFTASPDPRYFDKRSPVDGRVIAHIAEAGQADVDAAVTAARAALKGEWGKLSTDQRVDLLYGVANEITRRFDDFVAAEMADTGQPSHVQTHVFIPRGAANFKVFADVIKNVAAESFRMATPDGKGALNYAIRNPKGVIGVISPWNAPFLLMTWKVGPALACGNTVVVKPSEETPLTATLLGEVMNSVGIPKGVYNVINGFGPDSAGAYLTQHPGVDAITFTGETRTGTAIMKAAAEGMRDVSFELGGKNAGIVFADCNFEAAVDGIFRSAFLNTGQVCLGTERVYVERPIFENFVQALKAKVEGVRYGRPEDHTSTYGPLISQEHRDKVLSYYKKAVDEGATVVTGGGVPDMPAELAGGSWVQPTIWTGLPETAAVVREEIFGPCCHIRPFDSEEEVIELANANDYGLATTIWTENLSRAHRVAERVEVGVTWVNSWFLRDLRTPFGGSKQSGIGREGGVHSLEFYTETRNVCIKL

SEQ ID NO: 7249 - protein, 496 aa, Pseudomonas aeruginosa PAO1
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 7250 - protein, 493 aa, Eremothecium gossypii
MSFEDLHKAQRGKVEEPVDEICKDFEVTEDKLRELTAYFIECMEQGLKNGETDGTYRGLPMIPSYVMGRPNGTEEGTFLAADLGGTNFRVCSVRLNGDHTFKLEQLKSKIPEELLDDDVTSDELFGFIAKRTMAFVKRYHSEVLQSEGGQLKLGFTFSYPVAQTSLSSGTLIRWTKGFNIKDAIGKDVVKMYQEQLDAVGLGSVRVVALANDTVGTFLSHCYNSRNSASLTTGEITEPVIGCIFGTGTNGCYMEKLENIEKLPQELRQKLTAQGKTEMCINIEWGSFDNELKHLPTTKYDLLIDQKFTHNPGFHLFEKRVSGMFLGEVLRNVLVDLHSQGLILRQYPQGQLPHRLLKPFNLSSEILSHIEIDDSSDLRETELSLLQALRLPTTADERRQIQRLVRAISRRSAYLASVPIAAVIIKTGALEKRYHGEVEIGCDGSVFEFYPGFRSMMRHGLALSPLGPDGERKVHLHVAKDGSGVGAALCALVA

SEQ ID NO: 7251 - protein, 64 aa, Oryza sativa
FQQYNACSIIHIILFKNNFQEDLAKMGVMIRHYDKKELKGYIRISVGKPEHTDALMKGLKALQL

SEQ ID NO: 7252 - protein, 295 aa, Triticum aestivum
  unsure (1)..(295): unsure at all Xaa locations
MGGLSMEHPWAFAFGLLGNVISFSSLLAPIPTFYRIFKSKSTEGFQSVPYVVALFSAMLWIFYXTGSRPVRGLLISINAXGCVIETVYIVMYLVYAPKXAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVIQMVLYVFYMNKTPVASEVKEGKEAWKAPAEDHVVVINVGKADKSSCAEVRPVTEMASAVDVPRRCAAEAASPGQQVMAVDFARSVEVV

SEQ ID NO: 7253 - protein, 258 aa, Triticum aestivum
LANVGAELAHQVPGRVSTEIDARLAYDTQGIIHRVHELLNLYNQHDVSTDRLLFKIPATWQGIEASRLLESEGVQTHLTFVYSFAQAAAAAQAGASVVQIFVGRLRDWARNHSGDPEIDEALKKGEDAGLALAKKVYAYIHRNGYKTKLMVAAIRNKQDVFSLLGIDYIIAPLKILQSLEESVTDPDVKYGYVPKLTPAIGKTYNFTEEELVKWDQLSLSAAMGPAAEELLASGLEGYVNQARRVEELFGKIWPPPNV

SEQ ID NO: 7254 - protein, 453 aa, Arabidopsis lyrata subsp. petraea
MESSISQTLSKVSDPTTALLIVVSLFIFIGFITRRRRPPYPPGPRGWPIIGNMLMMDQLTHRGLANLAKKYGGLCHLRMGFLHMYAVSSPDVARQVLQVQDSVFSNRPATIAISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGS

SEQ ID NO: 7255 - protein, 366 aa, Rosa hybrid cultivar
MERLNSFKHLNQKWSNGEHSNELLHAQAHIWNHIFSFINSMSLKSAIQLGIPDIINKHGPMTLSELTSALPIHPTKSHSVYRLMRILVHSGFFAKKKLSKTDEEGYTLTDASQLLLKDHPLSLTPFLTAMLDPVLTTPWNYLSTWFQNEDPTPFDTAHGMTFWDYGNHQPSIAHLFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECIKILKRSRVAITSKDKKGKVIIIDMMMENQKGDEESIETQLFFDMLMMALVRGQERNEKEWAKLFTDAGFSDYKITPILGLRSLIEVYP

SEQ ID NO: 7256 - protein, 550 aa, Glycine max
GFFFFFFLIFHITLGTPQQKPGSLGSESSFALVTGNTTMDSAEKRLNELGYKQELRREMTLFKTLAISFSTMTLFTGITPLYGSSLQYAGPATLVWGWIVVSFFTWFVGIAMAEICSSFPTTGSLYFWAAHLAGPKWGPFSSWCCAWLETIGLIAGIGTQAYAGSQTLQSIILLSTGTNKGGGYFAPKWLFLCMYIGLTVIWAALNTFALEVIALIDIVSIWWQVIGGIVIVIMLPLVALTTKSASFVFTHLELAPESTGVSSKPYAVILSFLVSQYSLYGYDAAAHLTEETKGADKNGPIAILGSIGIITVFGWAYILALTFSIQDFGYLYDPNNETAGAFVPAQILYDAFHGRYHNSAGAIILLFVIWGSFFFGGLSITTSAARVVYALSRDKGVPFSHLWRQLHPKYKVPSNAVWLCAAICILLGLPILKVNVVFTAITSICTIGWVGGYAVPIFARLVMSEKNFKPGPFYLGKARRPVCLVAFLWICYTCSVFLLPTLYPITWDTFNYAPVALGVGLGLIMLWWLLDARKWFTGPVRNIDIQNGKV

SEQ ID NO: 7257 - protein, 131 aa, Glycine max
  unsure (1)..(131): unsure at all Xaa locations
STSIGAPLPWRPSVPFTSHNXNAPSRAEETCSEELFSFFRDMALMRRMEIAADSLYKAKLIRGFCHLYDGQEAVVVGMEAVITRKDCIITVYRDHCTFLARGGTLIEVFAELMGRRDGLSKGKGGSLHFYR

SEQ ID NO: 7258 - protein, 132 aa, Lotus corniculatus
PLKYYGLDKPGLHVGVVGLGGLGHMAVKFAKALGAKVTVVSTSPNKKTEAIEKLGADSFVVSPEQDQMKAVMGTFDGIIDTVSAVHPLLPLISLLKPHGKLVMVGAPEKPLEVPVFSLLGGRKTIAGSMIGG

SEQ ID NO: 7259 - protein, 157 aa, Corynebacterium glutamicum ATCC 13032
MVCSVTALVIVASTRAAAGVYEDRSGPILVSWLRAKGFDTPAPVIVADANLPAFLDELEFPQVVLISGGTGLTPDDITVDTLIPRLDKEIPGIAHAFWNYSMDAVPTAVLSRTVAGTIGGSFIMALPGSTGAARDATAVLDPLIDHITGTLQGHHEH

SEQ ID NO: 7260 - protein, 139 aa, Triticum aestivum
MASDSAARVDGSALAGRALAAAGARHMFGVVGIPVTSLASRAAAAGCRFLAFRNEQSAGYAAAAYGFLTGRPGLLLTVSGPGCVHGLAGLSHATANAWPLLMVSGSCDQRDAGRGDFQELDQIAATRPFAKLAVKAADI

SEQ ID NO: 7261 - protein, 318 aa, Carica papaya
MENFPVIDLSKLNGEERALTMELIHDACENWGFFELVNHGISHDLMDTVERLTKEHYMKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVSNYPPCPKPDLIKGLRAHTDAGGIILLFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 7262 - protein, 492 aa, Lycopersicon esculentum
MDPYKYRPSSAFNSPFCTTNSGAPVFNNNSSLTVGARGPVLLEDYHLVEKLANFDRERIAERVVHARGASAKGFFEVTHDIAHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLHMFTFLFDDIGIPQDYRHMDGSGVHTFTLINRAGKSTYVKFHWKPTCGVKSLLEEKAIRVGGANHSHATQDLYDSIAAGNYPEWKPSIQIMGPEHEDKFDFDPLDVTKTWPEDILPLQPVGRLVLNKNIDNFLYMNEQLAFCPSIVVPGVYYSDDKMLQTRIFSYSDTQRYRLGPNYLQLPANAPKCAHHNNHYDGSMNFMHRDEEIDYFPSRYDQVRHAEVYPIPSTVCSGKREKCIIQKENNFKQPGERYRSFTPDRQERFIRRWVEALSDPRITYEIRSIWITYWSQADKSLGQKLASRLNVRPSI

SEQ ID NO: 7263 - protein, 680 aa, Staphylococcus aureus subsp. aureus MW2
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEVGMVCDGYLMRIENLTPSNFFNSASEDTITKIKLNALREQRRILRELIDTDEVSEGTALKLREAINYDEMVIVDSMT

SEQ ID NO: 7264 - protein, 175 aa, Zea mays
MRRASCVPGRGGDRRGGAGGGGLAGAAAILFERLRSCTCGVGSAPSSDAEMWSRFPCIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 7265 - protein, 335 aa, Rhodobacter capsulatus
MARLAINGLGRMGKLLLRRLIDLGRGPEIVLLNDAMGDAETHALLLEFDTVHGRWPTPVAATETGLQIAGQRIRLTREKTLEALPLAEIGVDLVLDCTGQFKTAAKVQPYFDAGVRKVVVSAPVKDTGALNLVYGVNHVLYDGSQRLITAASCTTNCLAPIVKVIHEALGIKHGSITTLHDVTNTQTIVDRPAKDLRRARSALMNLIPTTTGSATAITLIYPELKGRLNGHAVRVPLLNASLTDCVFELDRPTTVAEVNSLLQTAAEGGLNGILGFETRPLVSSDFTNDPRSAVIDGPSTMVVNGTQLKLYAWYDNEWGYVCRMADIARMVAGSL

SEQ ID NO: 7266 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 7267 - protein, 319 aa, Prunus persica
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEQGYLKKAFYGTNGPTFGTKVSNYPPCPKPELIKGLRAHTDAGGLILLFQDDKVSGLQLLKDGQWIDVPPMRHSIVINLGDQLEVITNGKYKSVEHRVIAQTDGTRMSIASFYNPGSDAVIYPAPTLVEKEAEEKNQVYPKFVFEDYMKLYAGLKFQPKEPRFEAMKAVETNISLGPIATA

SEQ ID NO: 7268 - protein, 300 aa, Edwardsiella ictaluri
MTSLKAVIPVAGLGMKMLPATKAIPKEMLPIVDKPLIQKVVHECLSAGVKEIILVTHSSKNTIENHFDTSFELEALLEARVKRQLLDEVRSICPPGVTINSVRQHRQLGLGHAILCARPLVGEHPFIVALPDIWLDASTFDPETQNLAAMVRRFEESGRSQVLVQPMPLEALPEYSVINCADAVLEPGQSACMTSIVEKPEDAEKYHSDLSAVGRYVLSAAIWPILAATGFGAWERIQLSDAIATLLQHRPVEAYRQVGLSYDCGDKLGYAEAFVAGGLNHSQQGAAFTAWLQDVQTRIE

SEQ ID NO: 7269 - protein, 438 aa, GIBBERELLA ZEAE PH-1
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEGGVAPDIQTAEEALELITDAIEQAGYTGQMKIAMDVASSEFYKESEKKYDLDFKNPESDPTKWITYEELANMYSELCKKYPIVSIEDPFAEDDWEAWSYFSKTQDIQVVGDDLTVTNPLRIKKAIELKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 7270 - protein, 475 aa, Streptococcus pyogenes M1 GAS
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 7271 - protein, 630 aa, Zea mays
LHHSLPSRELRSREARKKEKWAQLVETYACSPATERGRGILLAGDPKTDTIAYCTGRSVIIRRLDAPLDAWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSASNPDQEPVTFAGHLKTVSSLVFFPQSSPRTILSTSYDGVIMRWIQGVGFGGRLVRRNNTQIKCFAAVEEELVTSGYDNKVFRIPLNGNQCGDAESVDIGGQPNALNLAIQKPEFALITTDSGIVLLHNSKVISTTKVNYAITSSSVSPDGTEAVVGAQDGKLRIYSISGDTLTEEALLEKHRGAITSIHYSPDVSMFASADTNREAVVWDRASREVKLKNMLYHTARINSLAWSPDSRLVATGSLDTCAIVYEIDKPVASRVTIKGAHLGGVHGLTFLDNDILVTAGEDACIRVWKVVQQ

SEQ ID NO: 7272 - protein, 566 aa, Actinobacillus pleuropneumoniae serovar 1 str. 4074
MVVQSLKDEGVEYVFGYPGGSVLDIYDAIHTLDNINHVLVRHEQAAVHMADGYARSTGKVGCVLVTSGPGATNAITGIATAYADSVPLVILTGQVPSALIGTDAFQECDMLGISRPVVKHSFMIKNPEDIPSIIKKAFYIASTGRPGPVLIDIPKDMVNPANKFTYEYPKEVSLRSYNPTVQGHKVQIKKALKALLVAKKPVLYIGGGIISAECATQLTDFATKLNLPVTSSLMGLGAFPASNKQFLGMLGMHGTYEANNAMHESDLILGIGVRFDDRTTNNLAKYCPNAKVIHVDIDPASISKTVPAYIPIVGSAKNVLEEFLSLLEEENLAKNQADLTAWWQQINEWKARQCLNFEVSKDVIKPQQVIRLIHKITNGDAYVASDVGQHQMFAALHYPFEKPRRWINSGGAGTMGFGLPAAIGVKFAHPEATVVCVTGDGSIQMNIQELSTAKQYDTPVVIVSLNNRFLGMVKQWQDLIYSGRHSQVYMNSLPDFAKLAEAYGHVGITIDHPNELEEKLTQAFAIKDKLVFVDVKVDETEHVYPMQIRGGAMNEMILSKTERTDA

SEQ ID NO: 7273 - protein, 330 aa, Pseudomonas sp. 7A
KLANVVILATGGTIAGAGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRLTPALQTLRKTGTQIIRSSHVNQGGFVLRNAEQPDDKNDWVVAHDLNPEKARILVELAMVKTQDSKELQRIFWEY

SEQ ID NO: 7274 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 7275 - protein, 540 aa, Chlorella kessleri
MAGGGPVASTTTNRASQYGYARGGLNWYIFIVALTAGSGGLLFGYDIGVTGGVTSMPEFLQKFFPSIYDRTQQPSDSKDPYCTYDDQKLQLFTSSFFLAGMFVSFFAGSVVRRWGRKPTMLIASVLFLAGAGLNAGAQDLAMLVIGRVLLGFGVGGGNNAVPLYLSECAPPKYRGGLNMMFQLAVTIGIIVAQLVNYGTQTMNNGWRLSLGLAGVPAIILLIGSLLLPETPNSLIERGHRRRGRAVLARLRRTEAVDTEFEDICAAAEESTRYTLRQSWAALFSRQYSPMLIVTSLIAMLQQLTGINAIMFYVPVLFSSFGTARHAALLNTVIIGAVNVAATFVSIFSVDKFGRRGLFLEGGIQMFIGQVVTAAVLGVELNKYGTNLPSSTAAGVLVVICVYVAAFAWSWGPLGWLVPSEIQTLETRGAGMSMAVIVNFLFSFVIGQAFLSMMCAMRWGVFLFFAGWVVIMTFFVYFCLPETKGVPVETVPTMFARHWLWGRVMGEKGRALVAADEARKAGTVAFKVESGSEDGKPASDQ

SEQ ID NO: 7276 - protein, 490 aa, Escherichia coli O157:H7 EDL933
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGDGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 7277 - protein, 523 aa, Ricinus communis
MPAVGGIPPSGGNRKVYPGNLTLYVTVTCVVAAMGGLIFGYDIGISGGVTSMDSFLKKFFPSVYRKKKADESSNQYCQYDSQTLTMFTSSLYLAALIASLVASTITRKFGRKLSMLFGGVLFCAGAIINGAAKAVWMLILGRILLGFGIGFANQSVPLYLSEMAPYKYRGALNIGFQLSITIGILVANVLNYFFAKIKGGWGWRLSLGGAMVPALIITVGSLVLPDTPNSMIERGQHEEARAHLKRVRGVEDVDEEFTDLVHASEDSKKVEHPWRNLLQRKYRPHLSMAIAIPFFQQLTGINVIMFYAPVLFDTIGFGSDAALMSAVITGLVNVFATMVSIYGVDKWGRRFLFLEGGVQMLICQAIVAACIGAKFGVDGAPGDLPQWYAVVVVLFICIYVSGFAWSWGPLGWLVPSEIFPLEIRSAAQSVNVSVNMFFTFVVAQVFLIMLCHLKFGLFIFFSFFVLIMSIFVYYFLPETKGIPIEEMGQVWKQHWYWSRYVVDEDYPNGGLEMGKEGRIPKNV

SEQ ID NO: 7278 - protein, 1062 aa, Schizosaccharomyces pombe
MHNIQASSITLGDCLGKGAFGAVYRGLNIKNGETVAVKKVKLSKMLKSDLSVIKMEIDLLKNLDHPNIVKYRGSYQTNDSLCIILEYCENGSLRSICKNFGKIPENLVALYTFQVLQGLLYLHNQGVIHRDIKGANILTTKDGTIKLADFGVATKINALEDHSVVGSPYWMAPEVIELVGATTASDIWSVGCTVIELLDGNPPYYDLDPTSALFRMVKDEHPPLPSNISSAAKSFLMQCFQKDPNLRIKTRKLLKHPWVIMNQTSSKFSDAIDEVQKYNERVKESTLTAIIEPTSNRINPTLHSGRQSSYHMPESPKTPIAESPDHDNWDNEFQGTLKISDDVLKKSEHFMDFCSNFKGKNNSSSITSSPSKSRHAFNSDQISESNNFNASPLSTPLKAQFDPSKPALNRSIDHQKTPQHKRYLSTEFKENIPDGIEKFVETPRDSEFTDIFPTSSIKVQGLRKETGLGTLVLNKCYGSWNNEENEDGEESDIFDSIETNLENLDIENNIALDKRTHLASLLSSLLGSLRDKNIGSKDTTVSQIASILSEDLSLKREIIQAHGILPLLETLREIKTPDVQLLLLKLINTVAFDDHTTLQKVCFAGGLPLMLSFSNREHSFEFRYESAIFIQQMYRTSALTLQMFLSSNGLNSLLLFIKEDYGTNRDFVFVGVEGIWKLLRQQDYIPKNDICTMVVNDSLEPLTKAMLKALATDDDSSRMSLTRICEILLALSQADNYVKESLLCESALRRILRILLYLPHSDMAITLQFFKQLSMVPSSLSLLRKVHIIPLLTHILGDSKIEKGRKEIRSEALAALFNVCKLDKKSQEEAVISGAIPLLQEVIIKDRLFKEFALPILLALPQAGPVSRIYLWQNKCLDFFLSLLSDLNWQSAVFDTIASWLQFELREVQRVLAEKRNVQLVLKVFCISQSASSNRMLDTLGRVCQISPRLAASYGQPIIFQKFKEKLTHKGTKPIVVLNIFQIMKSMCEASSQSVAYIAHCGLPDVVANLNQTSDSVLVKELAKDLLKYLKVPQGPINEHKSPISKPHMPPPRWQPKQPLTQ

SEQ ID NO: 7279 - protein, 219 aa, Streptococcus mutans UA159
MLLNQIAPSILAADYANFESELKRIEETGVKYVHIDIMDGQFVPSISFGAGVVASMRKHSKLVFDCHLMVVNPERYVDDFSQAGADIMTVHVEATHHIHGALQKIKDAGMKAGIVINPGTPVADLESVLSLADQILIMTVNPGFGGQAFIPEMLEKVRTVAKLREEKGLSFDIEVDGGIDNETIKLAKQAGANIFVAGSYLFKENLAAQVETLKAALND

SEQ ID NO: 7280 - protein, 399 aa, Oryza sativa (japonica cultivar-group)
MALSISTPPTSSSLLPASLQVGRWSSSAAMSARPVAFSLRRPVLAARVAAGGNAPSSSVDEVVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALAKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 7281 - protein, 158 aa, Triticum aestivum
  unsure (1)..(158): unsure at all Xaa locations
KKPPLPFLLPSLSPPSLSLFLSLRPSARPRALCAFLGRGEMAAKRELVVSFGEMLIDFVPTVAGVSLAEAPAFVKAPGGAPANVAIXLARLGGAAAFVGKLGDDEFGRMLAGILRDNGVDAGGVVFDSGARTALAFVTLRADGEREFMXYRNPSADML

SEQ ID NO: 7282 - protein, 283 aa, Triticum aestivum
  unsure (1)..(283): unsure at all Xaa locations
MASSAAAAVPESDRAALVKAFDESRTGVRGLVESGVSTVPDLFVHPDPYASVPLAPPGVSIPVVDLSLPAPVAAAAAAAAARDWGFFHLVNYEALVPADYPARALAAVRAFNELPAPERSAHYGRAMGGGVSYSSNVDLYRSAAASWRDTIQVGFGPTRPDTERIPPVCRSEIVEWEPPTTAVARAVMALLSEGLGLSEAALEEASCLEGKVMVCHYYPVCPEPERTMGLVPHTDPGVLTVLAQDGVGGLQGXKHTNEDGESYWVDAKPVPGALVINVGELFR

SEQ ID NO: 7283 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 7284 - protein, 431 aa, Nicotiana tabacum
MEMEYVTEYPRPYMDRRPKKRPRLDWDPSHTPKAQSGIYYGQEVGNSSSYVHSRLLPDHDSLYVKGLAQKGSPPRRDDDKDGHYMFELGENLTTRYKILKKIGEGTFGQVLECWDREQKGFVAIKIIRSIKKYREAAMVEVDVLQLLGRYDRGGTRCVQLRNWFDYRNHICLVFEKLGPSLFDFLRKNSYRAFPVDLVREIGRQLLECVAFMHDMRLIHTDLKPENILFVSADYIKVPDYKGTPWSHRDRSFSKRLPKSSAIKVIDFGSTAYERPDHNYIVSTRHYRAPEVILGLGWSYPCDLWSVGCILIELCSGEALFQTHENLEHLAMMERVLGPLPSQMLKRVDRHAEKYVRRGRLDWPEGATSRESIKSVMKLPRLQNLVMQHVDHSAGDLIDLLQGLLRFDPSIRMTAHDALRHPFFTKDQYRRL

SEQ ID NO: 7285 - protein, 472 aa, Escherichia coli K12
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 7286 - protein, 747 aa, Trichoderma viride
MRYRTAAALALATGPFARADSSSTSGASAEAVVLPAGTPWGTAYDKAKAALAKLNLQDKVGIVSGVGWNGGPCVGNTSPASKFSYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHATVQSANSGLDVSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWTGLPSQESGNALVDVLWGDVSPSGKLVYTIAKSPNDYNTRIVSGGSDSFSEGLFIDYKHFDDANITPRYEFGYGLCKFANTKFNYSRLSVLSTAKSGPATGAVVPGGPSDLLQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 7287 - protein, 352 aa, Geobacter metallireducens
MPESILATFTVKRLEIIAPDGTADEDLVPGLSGDELRRIYYLLLLTRAYDGRALALQREGRLGTYPSVLGQEAAQVGSAFAIHERDWVFPSFREMGVHLTLGYPAHQLFQYWGGDERGMRTPDGMNIFPISVSVGTHIPHAAGAALAAKLRGDPIAVIAYFGDGGTSKGDFHEGFNLAGVMGLPTVFICQNNQWAISVPLSAQTASRSLAQKALAYGFDGIQVDGNDVLAVYRATREALEKARSGGGPTFIECLTYRMSDHTTSDDASRYRSPEEMEQWRERDPILRYERFLAKRGLWNEDYAAEMKGKAGGEIDEAVRRYESVPPPAPGEMFNFVSGELSARLRRQRETST

SEQ ID NO: 7288 - protein, 417 aa, Coxiella burnetii RSA 493
MEHSQLYIILASIFSFFMAWGVGANDVANAMGTSVGSKAVTLTQAILIAAIFEVLGSLFAGGQVTDTIRGEIINANLFSQTPQLLVFGMLASLLAAGTWLIVATSFGWPVSTTHSIVGAVIGFGLTVVGAHAIHWYEVTNIVLSWIITPIIAGVIAYFLFRSVQWFIFDSETPLHNAKRYVPWYIFLVTLIVSLVTFLNGLKHVGLRISNSMAIGLSIAFSFVIMFFGYLLLRRIPVGTDNKYHIDFQKLEKVFGILMIFTACAMAFAHGSNDVANAIGPLAAVVGIVKGSGAVLASARIPFWIMLLGALGIVTGLTMYGYKVIATIGTNITQLTPSRGFAAQLATASTVVVASAAGLPISTTQTLVGAVLGVGVARGIGALNLSIVRNIFMSWIVTLPAGAIFSIIYYHLLKTIFL

SEQ ID NO: 7289 - protein, 263 aa, Oryza sativa
AAPLLPPPSAPSRLAAAPPLRFPPPLPLPPLSPPLSRSLSLSPSSSLHPLAPSPPPAPPRVAPAPRAPPRPHGGGGAGAPGGPRRPAGGRGSRESRPPCRGGGGAGGGGGLGGVMEQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 7290 - protein, 159 aa, Glycine max
MGSEGSSVVVPRNFRLLQELERGEKGIGDGTVSYGMDDADDIYMQSWTGTIIGPPGTVHEGRIHQLKLFCGKDYPDNPPSVRFQTRINMTCVNQETGAVEPHLFPMLANWKREHTMEDVLIQLKREMMSPQNRKLTQPPEGNEEARVDQKGLVVRCCIV

SEQ ID NO: 7291 - protein, 498 aa, Nostoc punctiforme
MTTPLSCRNYINGQWLNAVGEATLESRNPADKTEIVATYPRSQVNDVDTAVASARKAYRSWRTVPAPARAEYIFRVGEILLQHKEELAQLISREMGKPLTEARGDVQEGIDCAFYSAGEGRRLFGQTTPSEMSNKFAMTVRMPIGVCALITPWNFPVAIPCWKAMPALVCGNTVILKPAEDTSACATKLIEIFQQAGLPPGVINLVHGVGEEAGKALVEHPNVDLVSFTGSSETGAFVGATCGRTHKRVCLEMGGKNAQIVMEDADLELALDGAVWGAFGTTGQRCTATSRLILHRDIKEKFTTMLYERTSKLRLGAGNDTDTDIGPIINEKQLQQVSKYLDIAREEGAKVLIGGEIASEGSLKNGYFFQPTILDRVTPDMRVAREEIFGPVVALIEVSSFEEAIAILNDSNYGLSSSVYTRDINRAFTAMRDIEAGITYINGPTIGAEVHLPFGGVKQTGNGHREAGTTALDVFTEWKSVYVDFSGSLQRAQIDNRS

SEQ ID NO: 7292 - protein, 529 aa, Oryza sativa (japonica cultivar-group)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQVKVFKLEHYYAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 7293 - protein, 796 aa, Talaromyces emersonii
MMTRTAILTALAALLPTATWAQDNQTYANYSSQSQPDLFPRTVATIDLSFPDCENGPLSTNLVCNTSADPWARAEALVSLFTLEELINNTQNTAPGVPRLGLPQYQVWNEALHGLDRANFSDSGEYSWATSFPMPILSMASFNRTLINQIASIIATQARAFNNAGRYGLDSYAPNINGFRSPLWGRGQETPGEDAFFLSSAYAYEYITGLQGGVDPEHVKIVATAKHFAGYDLENWGNVSRLGSNAIITQQDLSEYYTPQFLASARYAKTRSLMCSYNAVNGVPSCSNSFFLQTLLRESFNFVDDGYVSSDCDAVYNVFNPHGYALNQSGAAADSLLAGTDIDCGQTMPWHLNESFYERYVSRGDIEKSLTRLYANLVRLGYFDGNNSVYRNLNWNDVVTTDAWNISYEAAVEGITLLKNDGTLPLSKKVRSIALIGPWANATVQMQGNYYGTPPYLISPLEAAKASGFTVNYAFGTNISTDSTQWFAEAISAAKKSDVIIYAGGIDNTIEAEGQDRTDLKWPGNQLDLIEQLSKVGKPLVVLQMGGGQVDSSSLKANKNVNALVWGGYPGQSGGAALFDILTGKRAPAGRLVSTQYPAEYATQFPANDMNLRPNGSNPGQTYIWYTGTPVYEFGHGLFYTEFQESAAAGTNKTSTLDILDLVPTPHPGYEYIELVPFLNVTVDVKNVGHTPSPYTGLLFANTTAGPKPYPNKWLVGFDRLATIHPAKTAQVTFPVPLGAIARADENGNKVIFPGEYELALNNERSVVVSFSLTGNAATLENWPVWEQAVPGVLQQ

SEQ ID NO: 7294 - protein, 371 aa, Bacillus subtilis
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGRSQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 7295 - protein, 451 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGV

SEQ ID NO: 7296 - protein, 486 aa, Gluconacetobacter diazotrophicus
MAKKAPSSAPTTTPSPSAEAVAKVFSLIQEHSVELVDLRFTDPRGKWHHTTQHISTIEQDTFRDGFMFDGSSIVGWKAINESDMVLLPDPTTAVMDPFSAKPQLILICDIIEPSTGQFYNRDPRATAKLAEAYLKSTGLGDTAFFGPEAEFFVFDSVKFGTGPNFGIYQLDSIEGPGASLKDYPEGNMGHRPTVKGGYFPVPPVDSENDLRAEMLSTMGEMGLPIEKHHHEVAQSQHELGTKFATLVKSADFMQIYKYCVHNVAHSYGKSATFMPKPIYGDNGSGMHVHQSIWKSGKPVFAGNGYADLSDQALYYIGGIIKHAKALNAFTNPSTNSYKRLIPGFEAPVLLAYSARNRSASCRIPYATSPKAKRVEVRFPDPTANPYLAFAAMLMAGLDGIKNKIHPGDAMDKDLYDLPPDELKQIPTVCGSLREALEALTADHEFLLAGGVFTKDQIESYIDIKWQEVFKFEHTPHPAEFEMYYSV

SEQ ID NO: 7297 - protein, 549 aa, Secale cereale
MAAAATRRAASSLASRCLLSRPAASPAAVPSALRRADGARGLLPGLLQRFGTAAAAEEPISPSVQVSETQLLINGKFVDAASGKTFPTLDPRTGEVIARVSEGDAEDVDRAVIAARKAFDHGPWPKMTAYERSRILLRFADLIEKHNDDIAALETWDNGKPYEQAAQIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 7298 - protein, 1067 aa, Arabidopsis thaliana
MAEENRKDRGVSSTVAIPSGLNRIKTRLASSGPRPEDSSDTVLKPPFNRNQKTIVPRGHGRTTGSSKQERKGTKLSRWLASYKPKYSCHPPKYACSSTTSSEEIKLRGKNSGKDEEKMIKISETNPPCSKSMGIKSFSHELGPRGGVQTPYPRPHSYNDLKELLGSLHSRFDVAKETVDKKLDVFVRDVKEAMEKMDPSCPEDREMAEQLLDVARACMEMTSAQLRATCESIVQDLTRKRKQCQAGLVKWLFSQLLFILTHCTRVVMFQKETEPIDESSFRKFKECLERIPALETDWGSTPRVDDSGSGYPEYQRNEAGQKFKRRDKESLESETALDYVVPNDHGNNAAREGYAAAKQEFPSHEPQFDSKVVEQRFYLSDEYEDKMSNEPGKELGGSDYVICRICEEEVPLFHLEPHSYICAYADKCEINCVDVDERLLKLEEILEQIIDSRSLNSFTQAGGLENSVLRKSGVASEGCSPKINEWRNKGLEGMFEDLHEMDTAFIDESYTYPIHLKSHVGAKFCHHATSSSTGSITSVSSTNTPRTSHFDSYWLERHCPEQEDLRLMMDLSDIARCGASTDFSKEGSCDYIMACMQDIQAVLKQGKLKALVIDTFGGRIEKLLCEKYLHARELTADKSSVGNIKESEDVLEHASATPQLLLKDRISIDDFEIIKPISRGAFGKVFLARKRTTGDFFAIKVLKKLDMIRKNDIERILQERNILITVRYPFLVRFFYSFTCRDNLYLVMEYLNGGDLYSLLQKVGCLDEEIARIYIAELVLALEYLHSLKIVHRDLKPDNLLIAYNGHIKLTDFGLSKIGLINNTIDLSGHESDVSPRTNSHHFQKNQEEERIRHSAVGTPDYLAPEILLGTEHGYAADWWSAGIVLFELLTGIPPFTASRPEKIFDNILNGKMPWPDVPGEMSYEAQDLINRLLVHEPEKRLGANGAAEVKSHPFFQGVDWENLALQKAAFVPQPESINDTSYFVSRFSESSCSDTETGNNSGSNPDSGDELDECTNLEKFDSPPYYLSLINFSFKNLSQLASINHDVLLQKDPAKGGGDSPFKSHGT

SEQ ID NO: 7299 - protein, 268 aa, Zea mays
  unsure (1)..(268): unsure at all Xaa locations
MFGYRKAGPDLEAGGSSLLYPGMTESPELRWAFVRKIYVILAVQLAMTAAVSAFVVKVPAVSNFFVSSNAGVALYIFLIILPFLGKPGSPVFWGIFSPXAEIGCNLLRAVLCPLRYYHQKHPVNLLLLGLFTVAISFAVGMTCAFTSGKIILEAAILTAVAGISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 7300 - protein, 308 aa, Brucella melitensis 16M
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRVKRMIALADIVKLSDEDLDWFGEKGSHDEIAAEWLKLGPKLVVITKGAHGAVAYTNHATVPVPGVKVDVVDTVGAGDTVNAGILASLHSQGLLTKDALANLSEDQIHSAVALGVRAATVTVSRAGANPPWAHEMRD

SEQ ID NO: 7301 - protein, 62 aa, Oryza sativa
IVEKYSNSNIEIHTFNQSQYPRIVTEDFLPLPSKGKTGKDGWLVFSDYSKMALVYTFDYNHL

SEQ ID NO: 7302 - protein, 355 aa, Streptomyces viridochromogenes
MKALILVGGVGSRLRPITHTSAKQLVPVANRTVLSYVLDSIKEAGISEVGIVVGATAAEIQASVGDGAEFGLDVTYIQQDAPRGLADAVLVSRDFLGDDDFVMYLGDNYVVDGIVDFVADFRRDKPAAQVMLARVADPRRFGVAELDENGRVTAVVEKPQDPRSDLAIVGVYAFSSAVHEAVAGIRPSWRNELEITDALQWLADHGHEVGSTVIDRYWKDVASVTDVLEMNRHLLESLETRIDGEVDEASELVGRVVVEAGAKISGSRIVGPAVIGPDTVVQDSYLGPFTSIEGNCRVAHSEIQYSIVLRGASIEGVARVEDSVIGRETEVNAAPRTSTAHRLVLGDHSRVQVGG

SEQ ID NO: 7303 - protein, 459 aa, Chrysochromulina sp. TKB8936
DPDYVIKETDVLALFRCTPQPGVDPVEAAAALAGESSTATWTVVWTDLLTACDLYRAKAYRVDPVPGTPDTYFCYIAYDLDLFEEGSLANLTASIIGNIFGFKAVKALRLEDMRFPVALLKTYQGPACGLIVERERMDKFGRPLLGATVKPKLGLSGKNYGRVVFEGLKGGLDFLKDDENINSQPFMRYRERFLYSMEGVNHASALTGEVKGHYLNSTAATMEDMYERADFAKELGSIIVMIDLVIGYTAIQSMAKWCRKTDVILHLHRAGNSTYSRQKNHGMNFRVICKWMRMAGVDHIHAGTVVGKLEGDPLMIKGFYNTLLDFKSDVSLPEGMFFAQDWASLRKCVPVASGGIHCGQMHQLINYLGDDVVLQFGGGTIGHPDGIQSGATANRVALECMVLARNEGRDYVAEGPQILRDAAKSCGPLQTALDLWKDITFNYASTDTADFVETPTANV

SEQ ID NO: 7304 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALDLANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 7305 - protein, 477 aa, Gracilariopsis megaspora
KNERCESGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRATAASGEIKGHYMNVTAATMEDMYERAEFAKHLGSIIIMIDLVIGYTAIQSMAIWARKNDMILHLHRAGNSTYSRQKSHGMNFRVICKWMRMAGVDHIHAGTVVGKLEGDPLMIKGFYNTLLQTNLEINLPQGIFFEQDWASLRKVTPVASGGIHCGQMHQLLDYLGNDVVLQFGGGTIGHPDGIQAGATANRVALEAMVMARNESRDYVAEGPEILRDAAKTCGPLQTALDLWKDITFNYTSTDTADFVETPTANV

SEQ ID NO: 7306 - protein, 180 aa, Nicotiana sylvestris
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 7307 - protein, 580 aa, Oryza sativa
MAGEVAIDSGEKRLNELGYKQELRREMTLFKTLAISFSTMTLFTGITPLYGSSLRYTGPASLVWGWVVVSFFTWFVGFAMAEICSSFPTTGSLYFWAAHLAGPVWGPLASWCCAWLEAIGLIAGIGTQAFAGSQVLQSIILLCTGTNKGGGYLTPRWLFLLMYIGLTFIWAVLNTFALEVIAFLDLISMWWQVIGGTVIVIVLPLVAKTTQPASYVFTHFETAPEATGIRSSAYATILSLLVSQYSLYGYDAAAHLTEETKGADKNGPIAILSSIGIITVFGWAYILALTFSIQDFSYLFDPSNETAGTFVPAQILFDAFHGRYGSSAGAIALLFVIWGSFFFGGLSITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKMHYKEVMGHCEPNQCTNLLHGATQLSPVNDSGPGTSTVKLCQRSASTPGIF

SEQ ID NO: 7308 - protein, 211 aa, Bacillus subtilis subsp. subtilis str. 168
MGKNPVVIGIAGGSGSGKTSVTRSIYEQFKGHSILMIQQDLYYKDQSHLPFEERLNTNYDHPLAFDNDYLIEHIQDLLNYRPIEKPIYDYKLHTRSEETVHVEPKDVIILEGILVLEDKRLRDLMDIKLYVDTDADLRIIRRIMRDINERGRSIDSVIEQYVSVVRPMHNQFVEPTKRYADIIIPEGGQNHVAIDLMVTKIQTILEQNAIL

SEQ ID NO: 7309 - protein, 419 aa, Staphylococcus carnosus
MPVEKRNPIPVREAIKRVVEQDIETEVQNVPLNKSLGYVLAEDIVATYEIPRFNKSPYDGFALRSEDTVGASGDNRIEFEVIDHIGAGSVSDKTVGPNQAVRIMTGAEVPAGADAVVMLEQTKEGDHTFTIRKTFSHNENVSLKGEETEVGDVVLKKGQRINAGGIAVLATFGYTEVPVRKLPSAAIIATGSELLDVGDELEPGKIRNSNGPMIEGLLNQFGLDGEVYKIQEDDLESSIAVVKQAMETHDMVITTGGVSVGDFDYLPEIYKALDAEVLFNKVQMRPGSVTTVAVAHGKYLFGLSGNPSACYTGFQLFVKTGVLNMMGANEKFPQVVKATLMEDFKKANPFTRFIRSKATLNGMEATVVPSGFNKSGAVVAIAHSNAMVMLPSGTRGFHAGNTVDVILTETDVFEEELLL

SEQ ID NO: 7310 - protein, 418 aa, ASPERGILLUS NIDULANS FGSC A4
MSATTARSDPFKPAARVAGQRQDVWSIVNEAAAASPVQPIVNMGQGFFGYNPPQFALDAAKAALDRVDCNQYSPTKGRPRLKKALADAYSPFFGRQLNPDTEVTITTGANEGMLSAFMGFIEQGDEVIIFEPFFDQYISNIEMPGGTIRYVPLQPPKDGATKTLPASEWSINFDELERTINPKTKMIVFSRDELERIGDLAVKHNLIILSDEVYDRLYYVPFTRIATMKPEYYERTLTVGSAGKAFYATGWRVGYLIGPEHLIKYVAGAHTRICYSSVSPLQEAAAVAFEEADKQGFWDQSREEMKRKMERFCEVFDELNIPYSDPEGGYFVLANMASVKLPEGYPFPPHVASRPRDFKLCWFLIHEVGVAAIPPTEFYTDANAHIAEDYLRFAVCKEDDVLETAKERLRGLKKYIVR

SEQ ID NO: 7311 - protein, 514 aa, Arabidopsis thaliana
MAGGAFVSEGGGGGRSYEGGVTAFVIMTCIVAAMGGLLFGYDLGISGGVTSMEEFLTKFFPQVESQMKKAKHDTAYCKFDNQMLQLFTSSLYLAALVASFMASVITRKHGRKVSMFIGGLAFLIGALFNAFAVNVSMLIIGRLLLGVGVGFANQSTPVYLSEMAPAKIRGALNIGFQMAITIGILVANLINYGTSKMAQHGWRVSLGLAAVPAVVMVIGSFILPDTPNSMLERGKNEEAKQMLKKIRGADNVDHEFQDLIDAVEAAKKVENPWKNIMESKYRPALIFCSAIPFFQQITGINVIMFYAPVLFKTLGFGDDAALMSAVITGVVNMLSTFVSIYAVDRYGRRLLFLEGGIQMFICQLLVGSFIGARFGTSGTGTLTPATADWILAFICVYVAGFAWSWGPLGWLVPSEICPLEIRPAGQAINVSVNMFFTFLIGQFFLTMLCHMKFGLFYFFASMVAIMTVFIYFLLPETKGVPIEEMGRVWKQHWFWKKYIPEDAIIGGHDDNNTN

SEQ ID NO: 7312 - protein, 338 aa, Streptococcus pyogenes MGAS315
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 7313 - protein, 348 aa, Glycine max
METRAAAKRKANAAIVVVVEKQHPKRQRVVLGELPNLQNLIVSKIQNPRKEKLQCRKNPNANKPSPTNNTLSSPQLDGSYVSDIHEYLREMEMQKKRRPMVNYIEKFQKIVTPTMRGILVDWLVEVAEEYKLLSDTLHLSVSYIDRFLSVNPVTKSRLQLLGVSSMLIAAKYEETDPPSVDEFCSITDNTYDKAEVVKMEADILKSLKFEMGNPTVSTFLRRYANVASDVQKTPNSQIEHLGSYIGELSLLDYDCLRFLPSIVAASVIFLAKFIIWPEVHPWTSSLCECSGYKPAELKECVLILHDLYLSRKAASFKAVREKYKHQKFKCVANLPTPPYVPSCYFEDQ

SEQ ID NO: 7314 - protein, 423 aa, Schizosaccharomyces pombe
VSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 7315 - protein, 78 aa, Glycine max
  unsure (1)..(78): unsure at all Xaa locations
MMIIEKVRAGSADLNMVVLTSECFHHNTEDGVDXLVVRLECLVAYDPSXXXIXWGAGGXTGDLTLEIXNKMQNIVCVR

SEQ ID NO: 7316 - protein, 335 aa, Xylella fastidiosa Dixon
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 7317 - protein, 169 aa, Trichodesmium erythraeum IMS101
MNKQIPHPDPENISLGCAVITVSDTRTGETDKSGQLLQEILRSSGHSITEYLIIKDEKLAVVAQMEALCQRDDIDAVIFNGGTGIAPRDTTYDAIEHLLEKTLPGFGELFRWLSYQEIGSRAIASRAVAGVYQSKLVFSLPGSTNAVKLAIKNLILPELVHLVLQLRKN

SEQ ID NO: 7318 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 7319 - protein, 745 aa, Cladosporium fulvum
MATEKISSGLGKLQDQLNGAAEGQKVAHVKNDPLYKDYHEPSNRITTDYGVKQHNTDDWLKIASEDKTGPMLLEDHAAREKINRFDHERIPERVVHARGSAAFGTFKLHKSLEQYTTAGVLTDTSRTTPTFLRFSTVLGSRGSADTVRDVRGFAIKHYTPEGNWDVVGNNIPVFFIQDAIKFPDVIHAGKPEPDNEVPQAQTAHNNFWDFQFMHTEATHMFMWTQSDRAIPRSYRMMQGFGVNTFTLTNAKGERFFVKFHWTPHLGVHSFVWDEALKLAGQDPDFHRKDLWEAIEAKAYPKWDFGVQVISEGEEDNFEFDILDATKVWPEELVPIQYVGELELNRNPDEFFPQTEQVAFCTGHVVPGIGFSDDPLLQGRNFSYQDTQISRLGVNFQELPINRPVCPVMNNNRDGALRHTVTKGKVNYWPNRFEATPPAAAEEKPYLDYPQKVAGMKTRLRSKKFSEHFNQAQLFYNSMSEPEKEHIKFALAFELDHCEDPVVYDRVSQRLADIDLSLAQSVADLVGGQIPQQQGRPNHGKKSKGLSQTEFPGKTPTIETRRIAIIIADGYDLVAYNGIVAAAKACQALPFTIAPRRSPIYAAGESKENSKGVKPDHHLEGMRSTMFDSVFVPGGADSVATLRKNGRALHWVREAFAHLKAIGAVGEAVDFVRNACQLPGMTFSASEEVTDSYGVVTAAKVKPESLSEAVKIGKDAADFVSKYFYEISQHKNFERELKGFPLMVAY

SEQ ID NO: 7320 - protein, 421 aa, Glycine max
  unsure (1)..(421): unsure at all Xaa locations
MASLPLGHHHHHHKPAAAAIHPSQPPQSQPQPEVPRRSSDMETDKDMSATVIEGNDAVTGHIISTTIGGKNGEPKETISYMAERVVGTGSFGVVFQAKCLETGEAVAIKKVLQDRRYKNRELQLMRLMDHPNVISLKHCFFSTTSRDELFLNLVMEYVPESMYRVIKHYTTMNQRMPLIYVKLYTYQIFRGLAYIHTALGVCHRDVKPQNLLVHPLTHQVKLCDFGSAKVLVKGESNISYICSRYYRAPELIFGATEYTASIDIWSAGCVLAELLLGQPLFPGENQVDQLVEIIKVLGTPTREEIRCMNPNYTEFRFPQIKAHPWHKVFHKRMPPEAIDLASRLLQYSPSLRCTALEACAHPFFDELREPNARLPNGRPLPPLFNFKQELAGASPELINRLIXPEHIRRQMGLSFPHSAGT

SEQ ID NO: 7321 - protein, 841 aa, Oryza sativa (japonica cultivar-group)
MPESNGAACGAAEKVKPAASPASEEPAAIAGNISFHAQYSPHFSPLAFGPEQAFYSTAESVRDHLVQRWNETYLHFHKTDPKQTYYLSMEYLQGRALTNAVGNLGITGAYAEAVKKFGYELEALVGQEKDAALGNGGLGRLASCFLDSMATLNLPAWGYGLRYRYGLFKQCITKEGQEEIAEDWLEKFSPWEIVRHDIVYPIRFFGHVEILPDGSRKWVGGEVLNALAYDVPIPGYKTKNAISLRLWDAKASAEDFNLFQFNDGQYESAAQLHARAQQICAVLYPGDATEEGKLLRLKQQYFLCSASLQDIFFRFKERKADRVSGKWSEFPAKVAVQLNDTHPTLAIPELMRLLMDVEGLGWDEAWDITNKTIAYTNHTVLPEALEKWSQIVMRKLLPRHMEIIEEIDKRFKEMVISTRKEMEGKIDSMRILDNSNPQKPVVRMANLCVVSAHTVNGVAELHSNILKEELFADYLSIWPNKFQNKTNGITPRRWLRFCNPELSEIVTKWLKTDQWTSNLDLLTGLRKFADDEKLHAEWASAKLASKKRLAKHVLDVTGVTIDPNSLFDIQIKRIHEYKRQLLNILGAVYRYKKLKGMSAEERQKVTPRTVMIGGKAFATYTNAKRIVKLVNDVGAVVNNDPDVNKYLKVVFIPNYNVSVAEVLIPGSELSQHISTAGMEASGTSNMKFSLNGCVIIGTLDGANVEIREEVGQENFFLFGAKADQVAGLRKDRENGLFKPDPRFEEAKQLIRSGAFGTYDYAPLLDSLEGNSGFGRGDYFLVGYDFPSYIDAQAQVDEAYKDKKKWIKMSILNTAGSGKFSSDRTIAQYAKEIWGITASPVS

SEQ ID NO: 7322 - protein, 306 aa, Lactobacillus plantarum WCFS1
MNKVTVLGSLNVDSILRFKRFPKPGETLPLTGKSVAGGGKGANQAIAAARAGAQTTFIGKVGTDQEGAFMVQQLTNSGVNDQYVQHSNVASTGSAFILLDSSSENRILIDGGTNQQVTAEDVERAQPAISASTFLIAQFETPIAATIRGFELAQAAGQKTILNPAPATTTVPAELLATTDLIVPNETETETLTGVHITDEQSMIQGAQKLQALGVANVIITVGSKGAFWMRGAEHGFVPAYKVEAVDTTAAGDTFIGALSSVLMPDFSNLAAAVRFANRASSIAVQKLGAQPSIPTKEAIEAAERA

SEQ ID NO: 7323 - protein, 330 aa, Enterococcus faecalis
MKMKTLKKSGLSKEELIQAYRQVLRGRRLDERLWQLTRIGKTSFNISGQGAEVAQVAMAMAFNPQKDYFLPYYRDMTACLVWGMTSKDILMGSFGKEADPSSHGRQMPNHYGSKEHNIVSFSSTVSTQMPLATGVGYAAQLQKADFVALTTTGEGSANQGEVQEAINFAGVKKLPVIFVVENNEYAISVPIEEQYANKRMADRAKAYGFEGVTVDGSDFAEVYLAFKEAVKAARGKKGPKLIELMVSRLTSHSADDDQSVYRSKEEIEEMKKNDAVKLFEKQLLEEGYLTDEDIAKIDEEIRAEINQATDEAEAMPDPVPTSILEEVYAK

SEQ ID NO: 7324 - protein, 267 aa, Shigella flexneri 2a str. 301
MIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 7325 - protein, 419 aa, Halobacterium sp. NRC-1
MALVLPNQSTETGQWVEIRWQRSPWKRLLRKSYSRRGRSSAHVRTGVPVTETIHRAPDDTYRVLDENGELVDGAEVPDLTDDELVEMYRYMKLARRFDERAVSLQRQGRIGTYPPLSGQEGAQIASAMALADDDWIVPSYREHGASLVRGLPLKDTLLYWMGDERGNAIPAEENIFTVAVPIASQIPHATGMGWASQLKDESDTAFMCYFGDGATSEGDFHEGLNFAGVYDTPNVFFCNNNQWAISVPREQQTATDTLAQKAAAYGFEGVQVDGMDPLAVYQVAHDAIEKAKDPDEDEMRPTLIEAVQYRFGAHTTADDPSVYREESEVEAWKDKDPIPRLETFLVETDRLDDAAIESIEADIEDAVADAIEAAEETPRPDPASMFENVYAEMPQRLEQQLEYFQSIRDEYGDEALLED

SEQ ID NO: 7326 - protein, 232 aa, Guillardia theta
MSRNLYSHDGRVEQLEFALELIDKSNSAIGIIYEKGILFATMEKNKHNSEKEYQNFTFALEKNIICIASGNIPDANTILFYLKSFADEYKLMFQETVPIEKIVGYLSDIMHKPTQMIYQRPLGVSFIIGGWDEFRGFQLFKIDPSGNFSGWRATSIGFNNILNQTLIEENYHNKINLKESIGIIVKLYYKNLNDYNFPNSFNLLKLYFDKNKNILIHRFNKKEIKMLRKVFK

SEQ ID NO: 7327 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKACEALAELADACGYPVAVMPSAKGLVPEHHSRFIGTYWGAVSTPFCAEIVESADAYLFAGPVFNDYSSVGYSLLLKKEKAIIVQPERVVVGHGPAFGCVLMKDFLHALATRLKKNTAAYENYRRIYVPLGEPLPSEPGEPLRVNVLFKHIQAMLSGDTAVIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 7328 - protein, 96 aa, Ferroplasma acidarmanus
MQRNQQQGQYDEENRKQIQEEEARRQQILRQILSTEARERLSTLKLVRPDLVSNVENQLIQLAGMGRINRVIGDEELKGILSRLIGNTRETKIERR

SEQ ID NO: 7329 - protein, 267 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 7330 - protein, 713 aa, Bacillus sp. 1011
MKRFMKLTAVWTLWLSLTLGLLSPVHAAPDTSVSNKQNFSTDVIYQIFTDRFSDGNPANNPTGAAFDGSCTNLRLYCGGDWQGIINKINDGYLTGMGITAIWISQPVENIYSVINYSGVNNTAYHGYWARDFKKTNPAYGTMQDFKNLIDTAHAHNIKVIIDFAPNHTSPASSDDPSFAENGRLYDNGNLLGGYTNDTQNLFHHYGGTDFSTIENGIYKNLYDLADLNHNNSSVDVYLKDAIKMWLDLGVDGIRVDAVKHMPFGWQKSFMATINNYKPVFTFGEWFLGVNEISPEYHQFANESGMSLLDFRFAQKARQVFRDNTDNMYGLKAMLEGSEVDYAQVNDQVTFIDNHDMERFHTSNGDRRKLEQALAFTLTSRGVPAIYYGSEQYMSGGNDPDNRARLPSFSTTTTAYQVIQKLAPLRKSNPAIAYGSTHERWINNDVIIYERKFGNNVAVVAINRNMNTPASITGLVTSLRRASYNDVLGGILNGNTLTVGAGGAASNFTLAPGGTAVWQYTTDATTPIIGNVGPMMAKPGVTITIDGRGFGSGKGTVYFGTTAVTGADIVAWEDTQIQVKIPAVPGGIYDIRVANAAGAASNIYDNFEVLTGDQVTVRFVINNATTALGQNVFLTGNVSELGNWDPNNAIGPMYNQVVYQYPTWYYDVSVPAGQTIEFKFLKKQGSTVTWEGGANRTFTTPTSGTATVNVNWQP

SEQ ID NO: 7331 - protein, 797 aa, Burkholderia fungorum
MAILRRCPAGGCRRRRRQQRSRRAASWRARRCIQRGPAALRRHRLHTACDAAVSGMARTPAGAATGLCLSQQSLRVAGRRPHRSHSVRSGKSQRSRRSACGRNVPVSARQDDRGGGARGIGQPEPDAGCAPSTSQGSGSDTASHRARLNFTGSRNRVCCRFDMRLRRPLPVAKVAYNPVASAQIALQCIGRLGYSVENAMSQTVGDFIIDRLHAWGVRRIYGYPGDGINGVFGALNRAHGKIEFVQVRHEEMAAFMASAHAKFTGELGVCIATSGPGASHLLTGLYDARLDHMPVLAIAGQQARAALGGHYQQELDLVSMFKDVAGAFVEQASVPSQVRHLVDRAVRTALAERKVTALVLPNDLQDLAYEAPARKHGTLHSGVGYRRPRLVPYPDDLQQAAEVLNAGKRVAILVGAGALHATDEVIAVADKLGAGAAKALLGKAALPDDLPWVTGSIGLLGTKPSYDLMTECDTLLVIGSGFPYAEFLPKEGAARGVQIDLKADMLSLRYPMEVNLVGDSVETLRALLPLLEQKQDRGWREKIEGWTADWWKTLDKRAHEAGRKGMNPQRSVWELSPRLPANAIVTSDSGSCANWYARDLKVQRGMMCSLSGGLASMGAAVPYAIAAKFSHPERPVIALVGDGAMQMNNMAELITVAKYWKQWASPRWICMVLNNSDLNQVTWEQRVMEGDPKFEASQDIPSVPYHRFAELIGLKGIYVEDPERMGAAWDEALAADRPVVIEVKADPDIPPLPPHITLAQAKAFASTLIKRDPNEGSVIIETAKQVLGAVLPGHRDK

SEQ ID NO: 7332 - protein, 343 aa, Caulobacter crescentus CB15
MARTRKAEASEGKAPETGVNAFVGKDELLKFYQDMLLIRRFEERAGQLYGMGLIGGFCHLYIGQEAIAVGMQSISQKGDQIITGYRDHGHMLAAGMDPREVMAELTGRAGGSSKGKGGSMHMFDIATGFYGGHGIVGAQVALGTGLALANSYRNNGNVSYAYMGDGAANQGQVYESFNMAQLWKLPVVYVIENNQYAMGTAVERAASETAFHKRGVSFRIPGEEVDGMDVIAVREAGARATEHARSGQGPYILEMKTYRYRGHSMSDPAKYRTKEEVDEVKTTRDPIDHIKERLAKAGVTEDDLKGVDAEVKRIVAEAAEFARTSPEPDPSELYTDVYLEAAE

SEQ ID NO: 7333 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 7334 - protein, 471 aa, Streptomyces coelicolor A3(2)
MATAPSVSYSMTVRLEVPAGGTAVSQLTTAVESAGGSVTGLDVTASGHDKLRIDVTIAAGSTAHADEIVEQLRGIEGVSLGKVSDRTFLMHLGGKIEMQSKHPIRNRDDLSMVYTPGVARVCMAIAENPEDARRLTIKRNSVAVVTDGSAVLGLGNIGPKAALPVMEGKAALFKRFAGIDAWPICLDTQDTDAIVEIVKAIAPGFAGINLEDISAPRCFEIEARLREALDIPVFHDDQHGTAIVVLAALTNALRVVGKGIENVRVVMSGAGAAGTAILKLLLAAGVKNAVVADIHGVVHTGRADLVDAAPESALRWIADNTNPEGLTGTLKEAVHGADVFIGVSAPNVLDGEDVAAMADGAIVFALANPDPEVDPAIARETAAVVATGRSDFPNQINNVLVFPGVFRGLLDAQSRTVNTEMMLAAAHALANVVTEDEINPNYIIPSVFNDKVAGAVAGAVRDAAKAAGVVA

SEQ ID NO: 7335 - protein, 124 aa, Geobacillus stearothermophilus
MGNYRIAVLPGDGIGKEVTSGAVEVLKAVGIRFGHEFAFEYGLIGGVAIDEAGTPLPEETLRLCQQSDAVLLGAVGGPKWDDNPPHLRPEKGLLAIRKQLDLYANLRPVVCYDSLVSASPLKPD

SEQ ID NO: 7336 - protein, 394 aa, Lycopersicon esculentum
MDGSAPQTDTVMSDAAAGQQPAMPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEDALAHPYLTSLHDISDEPVCMTPFSFDFEQHALTEEQMKELIYREGLAFNPEYQHM

SEQ ID NO: 7337 - protein, 199 aa, Triticum aestivum
MEDEEHEVYGQEIPVDGEDVDMGAGGDDAAKLHELDEMKRRLKEMEEEAAALREMQAKVAKEMQGGDPNATTSEAKEEMDSRSVFVGNVDYACTPEEVQQHFNSCGTVNRVTILTDKFGQPKGFAYVEFVEAEAIQEAVKLSESELHGRQIKVAPKRTNVPGLKQPRGGRGFNPYGGHPYMRPYPPPFYNPYGGYGRAP

SEQ ID NO: 7338 - protein, 308 aa, Glycine max
MFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAETFPIPPAICSGRREKCGIEKENNFKQPGERYRSWAPDRQDRFNRRWVDALSDPRVTHEIRSVWISYWSQADRSLGQKIASRLSMRPNI

SEQ ID NO: 7339 - protein, 493 aa, Agrobacterium tumefaciens str. C58 (Cereon)
MTIATPLKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 7340 - protein, 390 aa, Oryza sativa
  unsure (1)..(390): unsure at all Xaa locations
FFTDAYDLFYISLVTKLLGRIYYTDDSKNTLGALPPNVSAAVTGVALCGTLAGQLFFKWLGNKLGRKSVYGFTLILMVVCSVASGLSFGSSAKGVVSTLCFFRFXLGFGIGGDYPLSATIMLEYANKKTRGXFITAVFAMQKSGILFGAIVALAVSAKFRHTYPAPSYSNNHAASLVPQADYVWRIILMFGTVPAALTYYWRIKMPKTARYTALIARNAKQTTADMSKVLHTQIEESANRAETVAVGDESWGLFSRQFLRRHSLHLLATTNTWFLLNIAFYXKNLFQKNIFSKVGWIPPAKTMNALEELYRITRAQTLIALCGTIPGYWFTIAFIRIINRFWIQIMGFAIMTAFMLGLAISYHHXTTPGHHTGFIVMYGFTFFFANLGPN

SEQ ID NO: 7341 - protein, 765 aa, Escherichia coli O157:H7
MKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSIMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITILQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 7342 - protein, 435 aa, Glycine max
  unsure (1)..(435): unsure at all Xaa locations
PRRPSVRLFACTASDHVNLTRPEPYGAGVGGLSRDIPETANVKLPCNTTHCQNSSKSKPAPPITVGIVLLTIAVSAIGILTFTVYRRRKQKLGSTFDXRSDSHLSTDEAIGAYRKNGSPLVSLEYSTGWDPLADSRNFNGYSQEMFQSLRFNLEEVESATQYFSELNLLGKNSFSATYRGVLRDGSVVAVKSISKTSCKSDEGEFMKGLHMLTSLRSDNVVRLRGFCCSRGRGECFLVYDFVSNGNLSRYLDVKEGDGEVLEWSTRVSIVKGIAKGIAYLHAYKANKPALVHQSISAEKVLIDQRYNPLLSDSGLYKLLTNDVVFSALKGSAAKGYLAPEYTTTGRFTEKSDVYAFGVLLFQILTGKQKITSAMRLAAESFKFPEFIDPNLHGKFFEYEAAKLARMALLCSHESPFERPSMEAIVQELGNCSSCL

SEQ ID NO: 7343 - protein, 145 aa, Enterococcus faecalis V583
MTKPTEEELKQTLTDLQYAVTQENATERPFSGEYDDFYQDGIYVDIVSGEPLFSSLDKYDAGCGWPSFTKPIEKRGVKEKADFSHGMHRVEVRSQEADSHLGHVFTDGPLQEGGLRYCINAAALRFVPVADLEKEGYGEYLSLFK

SEQ ID NO: 7344 - protein, 349 aa, Xylella fastidiosa Ann-1
MFINAYGAHAGDKPLESMQIARRAPGAHDVQIDIHYCGVRHSDIHQVRAEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDSFLTLLKRDGTLTLVGAPVTPHPSPEVFNLIFKRRSIAGSLIGGIAETQEMLDFCAEHGIVADIELIRADGINEAYERMMKGDVKYRFVIDNSTLAA

SEQ ID NO: 7345 - protein, 262 aa, Zea mays
  unsure (1)..(262): unsure at all Xaa locations
KSGNPDSFIGSFIRRFGRTGVYRTFMFSKPTVLVATPDACKRVLMDDDSFLEGWPRATVALIGRKSFLTLPCEEHRRLRKLTAAPINGFDALTTYLGFIDRTVVATLRGWSDAGEIEFLTELRRMTFKIIVQIFLTAADDATTLALESSYTDLNYGMRAMAINXPGFAFHRAFKARKSWCXVLQGXVLNERRATKRLPAGSSVDMMDRLIEAEDEHGRRLDDXXIIDILVMYLNAXMESSGHICMWATVYLQKHPEIFAKAK

SEQ ID NO: 7346 - protein, 427 aa, Oryza sativa (japonica cultivar-group)
MGSRGDHGGGGGGRGAARATQLKVLVPSSFRKMRICDELAAQLGVGVGGGGAPRAATARVASPLGKAWDVGVVRDGDGRAFLGRGWAEFAAAHGLGVGWFVVLRHGGGVLAVEAFDTTCCLRVFGAPPAEAGRATDTSRKPQFLTVLLPGIMDKMRIPDKFVRDYITGENLNSNMAIILSPLGKSWRVELDKDQSGVFLGGGWLQFLSFHGISRGDVVIFRYEGNLVFKISVFGPNGRQKDFKAKGISIYQGTGEQQEAPSFSRRKCNNKKKSRFGEDDGNQQEMPCSRKGSGNKGRTSDRETKRMRKTRSVYEIGPRSWIKKEINEYVLERCILSLARTFCESIGLVEESSITLMMIDTTSTQGDQGGSSSSSRSWEVTGRRYKDACYLLGAGWRRFCEDNGVRSGDVCVFTVLDTTLWRVDIERC

SEQ ID NO: 7347 - protein, 338 aa, Mycobacterium tuberculosis CDC1551
MQEAPHRVMPLVRPCPRPSDPGEYVRPMTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 7348 - protein, 355 aa, Oryza sativa; identical to SEQ ID NO: 2022

SEQ ID NO: 7349 - protein, 149 aa, Zea mays
MISSKRLVQMAKKWQATAAMARRRLTATLAKEADGSCGTSMPVAVRGHCVVYSSDGTRFEVPLAYLGTAVFGELLSMSREEFGFTGDDGGRITLPCDAAVMEYAMCLLRRDASEEVVRAFLSSMVRPCHHSVGGSVPPMGLGRQPAICV

SEQ ID NO: 7350 - protein, 510 aa, Ricinus communis
  unsure (1)..(510): unsure at all Xaa locations
MAAGLAITSEGGQYNGRMTSFVALSCMMAAMGGVIFGYDIGVSGGVTSMDPFLKKFFPDVYRKMKEDTEISNYCKFDSQLLTSFTSSLYVAGLVASFFASSVTRAFGRKPSILLGGXVFLAXAALGGAAVNVYMLIFGRVLLGVGVGFANQAVPLYLSEMAPPRYRGAINNGFQFSVGIGALSANLINYGTEKIEGGWGWRISLAMAAVPAAILTFGALFLPETPNSLIQRSNDHERAKLMLQRVRGTTDVQAELDDLIKASIISRTIQHPFKNIMRRKYRPQLVMAVAIPFFQQVTGINVIAFYAPILFRTIGLEESASLLSSIVTGLVGSASTFISMLIVDKLGRRALFIFGGVQMFVAQIMVGSIMAAELGDHGGIGKGYAYIVLILICIYVAGFGWSWGPLGWLVPSEIFPLEIRSAGQSIVVAVSFLFTFVVAQTFLSMLCHFKSGIFFFFGGWVVVMTAFVHFLLPETKKVPIEKMDIVWRDHWFWKKIIGEEAAEENNKMEAA

SEQ ID NO: 7351 - protein, 472 aa, SYNECHOCOCCUS SP. WH 8102
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWLG

SEQ ID NO: 7352 - protein, 427 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTADFV

SEQ ID NO: 7353 - protein, 514 aa, Zea mays
MDALPEAWSQVRAPVIVPLLRLAVAVCLTMSVLLFLERVYMAVVISGVRLLRLRPDRRYRCDPLPEDDPELGSSAFPVVLVQIPMFNEREVYQLSIGAVCGLSWPADRLVVQVLDDSTDEVIKEMVRMECERWARKGINITYQIREDRKGYKAGALRAGMRHAYVRDCEYVAIFDADFQPDPDYLKRTIPYLVHNPEIALVQARWRFVNADECLMTRMQEMSLDYHFTVEQEVSSSVCAFFGFNGTAGVWRISAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCVIIPATIFVPEVRIPKWGCVYIPSAITLLNSVGTPRSFHLLFFWVAFENVMSLHRTKATLIGLLEAGRANEWVVTAKLGSAMKMKSANKAGLRKQFMRIWERLHVTELGVAAFLFSCGWYDLAYGRDHFFIYLFFQSVAFFIVGVGYVGTIVPQS

SEQ ID NO: 7354 - protein, 635 aa, Oryza sativa
MTAGGKPQSTPITLIVPGLESFVCRASFRSRSIARLYCQSGALGDEHTARPLQLAKEFWSQRRVQKESQYIEGETVWLDYKSDTARARVVLDKPLELRPDPGIRRRNLARVPENVTGATAASNQKRLQQGSNRGGGGARQQQHQAGQWRSCHQCCRAGGWLGAGGGQIEVPANYMKVGKRIVPAARIPDGNASTSRGNAHQSGSNSNQNVALNLSLLAPPSSPASFSNSAIPSTAQSPNRFLSISANSPGGPTSNMFAVGPYANEPQLVSPPVFSTYTTEPSTAPLTPPPELAHATTPSSPDVPYARFLLSAMDLKTAGKDHNMPYLSTAYSGGSGLQASYPLYPESPSSSLISPASATPRTGLSSPIPEQEVPTAHWKTSRSACDTPYSRASPIPEQEVPTAQWKTSRSACDTPYSRNSPSNIFGLDSAASRNYMLDNNFFRPAASAQFYLDQAQQSFPYNNGGRISVSRDKQDAEEVEAYRASFGFSADEIVTTQAYVEIPDALDEGFSISPFGNNAPATEVDKPLFNVKVTTSPKKSADQLSNDSPHNVVHLDIFKGTKGGDLSEDEGVVKDCHPFRKAMDEISLKPIEVRKKVQPGQSSSSDAEIEYRRARSLREANGVLSWRSTLARQLQ

SEQ ID NO: 7355 - protein, 318 aa, Zea mays
RNSARGTFEGFTGTSSLPTTNDDDASSTTTEAMFIISPNGKFKRKIKSWMRGALLGSGSFGMVYEGISDEGAFFAVKEVSLLDQGSNAQQSIVALEQEIALLGQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNVEWTNAFFMIGRGEQPTIPCYLSKEAQDFIGQCVRVDPESRPSASQLLEHPFVNRPLRASFESSSPPAI

SEQ ID NO: 7356 - protein, 592 aa, Vibrio parahaemolyticus RIMD 2210633
MKHTLNIPILGFAAYSGTGKTTLLEALLPKLTEAGLRIGMLKHAHHNFDVDKPGKDSYRLRKAGASQMLIASRNRFALMTETPEAEAEFEYLLTRFDEDKLDVVLVEGCKNIAFPKIELHREEVGKPWLYPHDENIIAIASDSAELDSELPQMNINDLDAIAQFVLQYVQDAKAPKSKEKDAACCDTLSPAFLSVVQGQEKILSLVNTVSEIEACKIENAYGRVLAEDIISPVNVPQYTNSAMDGYAIRSDDVDRDSYQIVAEVMAGHAYDQPLEVGQAVKIMTGAPTPRNGDTVVMREQASQEGDKVTFNGAHIKAGQNVRQAGEDLAIGSDVFTAGTRLASPEMGMIASLGFGEANVFRKLKVAVFSTGDEVQAPGTEQKANSIYDSNRFTIMGMLEKLGCEILDFGILEDNEQLMIEALENASAQADVVMTSGGVSVGDADYIKLALDKLGQVDFWRINMRPGRPLAFGQINNKPFFGLPGNPVAVMVSFINFVEPALRKMQGEQGWKPLKVKAIATENLRSRQGRTEFSRGIYELDDTGRLTVRTTGKQGSGILRSMSDANCLIEISPAIDTVKAGESVTIIPLQGRI

SEQ ID NO: 7357 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILPGGAGTHLFPLTNRAATPAVPLGGCYRLIDIPMSNCINSGVNKIFVLTQFNSASLNRHISRTVFGNGVSFGDGFVEVLAATQTQGETGMKWFQGTADAVRQFSWVFEDAKNKDIDNIVILSGDQLYRMDYMDLVQNHIERNSDITLSCATVGDSRASDFGLVKIDRRGRVVQFCEKPKGTEHKAMQVDTTLLGLPRQDARLNPYIACMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKHVVITNKDGVQESDRPDEGFYIRSGITIIMEKATIRDGTVV

SEQ ID NO: 7358 - protein, 83 aa, Cucumis sativus
ERVVHARGASAKGFLRVTHDITNLSCADFLRAPGVQTPVIVRFSTVIHERGSPETLRDPRGFAVKFYTREVRILVVYAFIGCT

SEQ ID NO: 7359 - protein, 350 aa, Schizosaccharomyces pombe
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKAATNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 7360 - protein, 338 aa, Streptococcus pyogenes MGAS8232
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGVAPGQWIVIFGAGGLGNLAVQYAKKVFNAHVVAVDINNDKLELAKEVGADILVNGKEIEDVPGYIQEKIGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 7361 - protein, 474 aa, Zea mays
  unsure (1)..(474): unsure at all Xaa locations
MDMALASKASPPPWNATAAEQXIPKRDKAAANDSTYLNPQAHDSVLGIILGGGAGTRLYPLTKKRAKPAVPLGANYRLXXXPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 7362 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 7363 - protein, 221 aa, Synechococcus sp. PCC 7942
MASDSAVWLRRLPLIAGAIGGTLLMVNRALTPELLPTQSRSDALGILLSALLILSGLLWQRVQPVPPEMVVLEGEEGFELDDQLPEASRQELAWASKLLLTNTITGSLLIWYDGQVLLRRGILAPPVPVQPGPIVERVLKTGKAVYLVDLKLYPGRIEFNYLPANSQGLICQPLGNRGVLLLAARAPRSYTQQDERWIAGIADKLDQSLSRSAAAIAVEQP

SEQ ID NO: 7364 - protein, 74 aa, Zea mays
MEDMYRSFHPEATILSDLTNAPLLSLLTCMDSWHPALVVNALDKPRAMLDNMMRNCKGLCPANNMRLEYKRAKY

SEQ ID NO: 7365 - protein, 312 aa, Oryza sativa
MGWGIRRQPQQQAAAAAERGGGGKGKAAAFSFSPLSWIAKLTARSSHGKCGGAKHAPAASMAGPSCRLPKRAAAAAASSSSVVAAVDDVAAGRSSPPRRSPVDVAPRRLSVGNDSAEAVARRLCQQQRRRRRHCSLGGDRDLPPLGHLIPFSLAGSPASQPPENAAAAAAGGATPSDTDAGAKLRTRRHRRRAHRRRRSSLGGSGRRSFSVSGRMPAVRIRPPRAAASAPELERLAVVRRTRDPQRAFRESMVEMIASSGGSIAARPEELERLLACYLALNADEHHDCIVKVFRQVWFEYINLHLHLSRRRR

SEQ ID NO: 7366 - protein, 453 aa, Kluyveromyces lactis
MKWIYTFIAAVSATVTFHPENVEYSLSAKELDPASLGIDTVNQWSGYLDYQDKKHSFYWFFESRNDPANDPVILYLNGGPGCSSMDNLFFETGPASIGPDLKPIHNPYSWNNNASIIFLDQPVNVGFSYSEERVKTTNDAARDVYNFLDLFFTKFPNLTANAFHIAGESYAGHYIPRIAHEIVSVHKDDTKFNLSSIVIGNGLTDPLVQNQYFKPMACGEGGYPAILNPSKCRTMSVSNLACKGLTSLCSKTKLTPGRAYLLLHFCWKSLIQPAFDSAVNPCDIRGPCEDPESGLCWKTLGYIRSYLNQEFVQDALGTKVSSYNGCNTSVGSDFFLTGDNSRPFQQYVTELLDLNIPVLIYAGDTDYICNWLGNMAWTDALTWKDHISYETLPLNPWYSLNGSVQFGEVKNHGPFTFLRVFEAGHTVPYYQPLATMEMINRWISGDLSLGYSN

SEQ ID NO: 7367 - protein, 176 aa, Glycine max
  unsure (1)..(176): unsure at all Xaa locations
MVLEATMICIDNSEWMRNGDYSPSRFQAQADAVNLICGAKTQSNPXNTVGVLTMAGKGVRVFVTPTSDLGKILACMHGLDIXGEMKLAAXIXVAQLASKHPQNKNXQQRFMAFVXNPVKHEKKMLELLEKVKKKKGPLELEFWEKNRGKKKIGTPPPCLKKRTPPLFVVPRGQRRF

SEQ ID NO: 7368 - protein, 407 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVYSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 7369 - protein, 154 aa, Griffithsia japonica
MNPEYDYLYKNLLIGDSGVGKSCLLLRFADDTYTESYISTIGVDFKIRTIELDGKTIKLQIWDTAGQERFRTITSSYYRGAHGIIIVYDVTDQESFNNVKSWLQEIDRFASEHVCKLLVGNKNDMTSKKVVDTETAKNFADSLGIKFLETSAKT

SEQ ID NO: 7370 - protein, 148 aa, Listeria monocytogenes
IMYLFSDEGTPASYREVRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGM

SEQ ID NO: 7371 - protein, 123 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAG

SEQ ID NO: 7372 - protein, 335 aa, Geobacillus stearothermophilus
MAVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 7373 - protein, 355 aa, Neurospora crassa
MAEFIRAQIFGTTFEITSRYSDLQPVGMGAFGLVCSAKDQLTNQNVAIKKIMKPFSTPVLAKRTYRELKLLKHLRHENVGLPDSIAQAIGNHATNMLAQQVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMM

SEQ ID NO: 7374 - protein, 90 aa, Brassica rapa subsp. pekinensis
  unsure (1)..(90): unsure at all Xaa locations
MKGDYHRYLAEFKAGDERKETAESTLVAYKSAQDIATAELAPTHPIRLGLALNFSVFYYXILNSPDRACTLAXQAFDEAIAELDTLGEES

SEQ ID NO: 7375 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 7376 - protein, 481 aa, Pseudomonas sp.
MFHVPLLIGGKPCSASDERTFERRSPLTGEVVSRVAAASLEDADAAVAAAQAAFPEWAALAPSERRARLLRAADLLEDRSSEFTAAASETGAAGNWYGFNVYLAAGMLREAAAMTTQIQGDVIPSNVPGSFAMAVRQPCGVVLGIAPWNAPVILGVRAVAMPLACGNTVVLKSSELSPFTHRLIGQVLHDAGLGDGVVNVISNAPQDAPAVVERLIANPAVRRVNFTGSTHVGRIIGELSARHLKPAVLELGGKAPFLVLDDADLDAAVEAAAFGAYFNQGQICMSTERLIVTAVADAFVEKLARKVATLRAGDPNDPQSVLGSLIDANAGQRIQVLVDDALAKGARQVVGGGLDGSIMQPMLLDQVTEEMRLYREESFGPVAVVLRGDGDEELLRLANDSEFGLSAAIFSRDVSRAMELAQRVDSGICHINGPTVHDEAQMPFGGVKSSGYGSFGSRASIEHFTQLRWLTIQNGPRHYPI

SEQ ID NO: 7377 - protein, 148 aa, Glycine max
  unsure (1)..(148): unsure at all Xaa locations
MFIENFKVECPNVKYTETEIQSVYNYETTELVHENRNGTYQWIVKPKSVKYEFKTNIHVPKLGVMLVGWGGNNGSTLTGGVIANREGISWATKDKIQQANYFGSLTQASAXIRVGSFQGEEIYAPFKSLLPMVNPDDIVFGGWDISNM

SEQ ID NO: 7378 - protein, 593 aa, Paracoccus denitrificans
MRMTTEESFVKTLQLHGIEHAFGIIGSAMMPVSDLFPRAGITFWDCAHETNAGMMADGFTRSTGRMSMAIAQNGPGVTGFVTPVKTAYWNHTPLLLVTPQAANRTIGQGGFQEMEQMRIFADCVCYQEEVRDPSRIPEVLNRVIMQAWRNSAPAQINIPRDFWTQVIDVDLPQVVGFERPAGGERAVAEAARLLSEARFPVILSGAGVVLSGAIPDLVGLAERLDAPVCSNYQHNDSFPGSHPLAMGPLGYNGSKAAMEIIARADVVLALGTRLNPFSTLPGYGIDYWPKDARIIQVDINADRIGLTKKVAVGIQGDAAKVARGILAQLAPAAGDAGRQERRDLVAQTRSRWAQELSSLDHEEDDPGTEWNEQARARDAGLMSPRQAWRAIMQAVPKEAIVSSDIGNNCAIGNAYPSFEAGRKYLAPGLFGPCGYGFPAILGAKIGNPEVPVIGFAGDGAFGISMNEMTACGREDWPAITMVIFRNYQWGAEKRNTTLWYDNNFVGTELDRDTSYAKIAQACGLVGVQVRSQEELTAALHDAVERQMQGRETTFIEVLLNQELGEPFRRDAMKKPVAVAGIDPADMRPQQGAA

SEQ ID NO: 7379 - protein, 519 aa, Orobanche ramosa
MTEQLGAAAKFRRSGGSPTKALINKPKKNMYALLISVMASMTSILLGYDTGVMSGATLYIKKDLKITDVQVEILVGLINIYSLIGSAVAGRTSDYLGRRITIVIASVIFFVGAAVMGLANNYAVLMVGRFVAGLGVGYALMIAPVYAAEVAPASSRGFLTSFPEVFINFGVLLGYLSNYAFAKFSLKLGWRLMLGVGALPAIFIGLAVIVMPESPRWLVMQGRLGDAKKVLDRTSDSPQEAQLRLADIMEAAGLPEDCHDDVVPVLKQDRGGGGVWKELIVHPTKPVLHITIAAVGCQFFQQASGIDAVVMYSPRIYEKAGITSDEKKLLATIAVGLCKTVFILVTTFMVDRIGRRVLLLTSCGGLVLSMLTLATGLTVIDHYGADRFPWVVVLCVLTTYSSVAFFSMGMGPIAWVYSSEIFPLKLRAQGCGLGVAINRATNGVILMSFISLYNAITIGGAFYLFSGIGIVTWIFFFTLLPETRGRTLEDMEVLFGTFFKWRTTMRELHKKEAEDALYA

SEQ ID NO: 7380 - protein, 316 aa, Staphylococcus epidermidis ATCC 12228
MKYIDEQTQAQLLDMNEVILEVEKALQAFSENKTITPLRYVLPFNEQNRYLVMPALSDELNIVGLKTVSFAPENSKKGKATITGSVILSDYETGETLSILDGGFLTKVRTGAISGVATKYLAKENAKTLSVIGAGVQAEGLIEAILAVRDIEKIHIASRTFEKAEKFAQNIRNRFNIKVSVFRSADEAIDSADIVVTATNANQPVYTHSLHPGVHLNAVGSFKPDMQEIPSETMLVANKIVVESMEAALEETGDLKIPQAEGILTKNMLHSELGDIISGEKVGRETEEEVTVFKSVGLAIVDIIVAQYFYKKLIQS

SEQ ID NO: 7381 - protein, 63 aa, Cryptoperidiniopsoid sp. brodyi
MRGILADWLVEVHLKFKLVPETLYLTVNIIDRFLQIHKVSRPKLQLVGVTSLLIASKYEEIYP

SEQ ID NO: 7382 - protein, 284 aa, Vibrio fischeri
RDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVS

SEQ ID NO: 7383 - protein, 151 aa, Yersinia enterocolitica
AVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATR

SEQ ID NO: 7384 - protein, 146 aa, Triticum aestivum
  unsure (1)..(146): unsure at all Xaa locations
RPGAHPPQAVGADACVITYFGDGGTSEGDFPCSXLNFAAVMEAPVIFFCRNNGWAISTPTTEQFTILLQADGVVIRGQAYGIRGIRVDGNDALAXYSAVHAAREMAITEGRPILVEXLTYRVGHHSTSDDSPKYRPVDGMPHPPVA

SEQ ID NO: 7385 - protein, 419 aa, Prionitis patens
DTDVLALFRVTPQPGVDPIEASAAVAGESSTATWTVVWTDLLTACDLYRAKAYKVDAVPNSSEQYFSYIAYDIDLFEEGSIANLTASIIGNVFGFKALKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGIWARKNDMILHLHRAGNSTYSRQKSHGMNFRVICKWMRMAGVDHIHAGTVVGKLEGDPIMIRGFYNTLLLTHLEVNLPQGIFFEQDWAALRKVTPVASGGIHCGQMHQLLDYLGDDVVLQFGGGTIGHPDGIQAGATANRVALEAMVIARNEGRDFVAEGPQILQDAAKTW

SEQ ID NO: 7386 - protein, 134 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 7387 - protein, 77 aa, Glycine max
MASLMLSSPAVTTDNRAGAGMVAPFTGLKSMAGFPTRKTINDITSIASTGGRVLCMQVRPPLGKKTFETLSYLPDLD

SEQ ID NO: 7388 - protein, 82 aa, Chlamydia trachomatis
FVEAFVKAGADRIIVHFEAAENIKEIISYIQKCGVQAGVAFSPETSIEFVTSFIPLCDVILLMSVHPGFCGQKFIPDTIERI

SEQ ID NO: 7389 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 7390 - protein, 447 aa, Caloglossa beccarii
ALFRVTPQPGVDPIEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTIEDMYERAEFAKELGTVIIMIDLVIGYTAIQTMAIWARKNDMILHLHRAGNSTYSRQKIHGMNFRVICKWMRMAGVDHIHAGTVVGKLEGDPLMIRGFYNTLLLPFLNIDLPQGIFFTQDWASLRKVTPVASGGIHCGQMHQLLDYLGNDVVLQFGGGTIGHPDGIQAGATANRVALESMVMARNEGRDYVAEGPQILRDAAKTCGPLQTALDLWKDITFNYTSTDTADFVETPTANV

SEQ ID NO: 7391 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 7392 - protein, 434 aa, Buchnera aphidicola str. Sg (Schizaphis graminum)
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 7393 - protein, 408 aa, Pseudomonas fluorescens PfO-1
MNPVGKPGKTGSLMPVEAALTRLLEMAEGSRIVESEFLPLAQVQGRVLAQDLVSTLDLPPWPNSAMDGYALNLADWTGEPLPVSQKVFAGQAPEPLKPRTCARIFTGAPVPAGADCVEMQENVEIHADERVSFTETMVSGQNIRPQGQETTVGELVLPAGTRLGPIEQGLAASLGCAGLEVVRRVRVAVLSTGDELVEPGTPLGPGQIYNSNRVLLCSWLQRLGCEVVDAGILPDDLSTTRARLGELQDVDLILSTGGVSVGEADFLGIALREEGELTLWKLAIKPGKPLTVGHFRGVPVIGLPGNPASTLVTFALLTRPYLLRLQGVQDVEPLKFSVPAGFVWPQAGNRREFLRGRLEQGQAIIYRNQSSGVLRSAAWAEGLVEVREGRVLVKGDQVLFIPLSELLG

SEQ ID NO: 7394 - protein, 798 aa, Agrobacterium tumefaciens str. C58
MRPIKDILETMEYGPSPEANGDVKQWLDAHGRSFGHYINGRFVSPDGRKTIAVSNPANGDKLAEIVCGNEEDVDQAIKAARAAFGKWSKLSGHARARYLYAIARHIQKRERFLSVLETMDNGKPVRETRDIDIPLVARHFYHHAGWAEMVEDEFHGFSPVGVCGQVIPWNFPLLMLAWKIAPALAAGNTVVLKPADLTPLTAIAFAEICHEVGLPAGVVNIVQGDGSTGAAICGHDGVDKVAFTGSTKVGRVIREQIAGSGKKLSLELGGKSPFIVFEDADLDAAVEGVVDAIWFNQGEVCCAGSRLLVQEGIAEKFYARLKKRLETLRVGDPLDKSTDVGAIVSATQVKRITDLVRKGVEEGGELWQSSNPLPPTGNYVAPGFFTDVDQASTVCQVEIFGPIAAATTFRTPDEAVSLANNTRYGLAASIWSENINVALDLAARVKAGVVWINCTNMLDAGAGFGGYRESGFGREGAREGLYEYLAADWEKNLSVSKPAEAFAPSALPNADSKKAIDGLDRTMKNYIGGKQARPDGGYSYSVTGKGNAVIGMAGIGNRKDIRNAVEAASKAGSWSSATAHNRAQVLYYLAENLNARRDEFVARIIDSTGVSEKKARDEFDASLRRISYYAAQADKFDGAIHSTKSRHVTLAMNEPWGIVGIVCPDEAPLLSLVSLVLPAIAMGNRVVVIPSSRHPLIAGDFYQVLDTSDVPGGVINIVTGERDMLAKTLAEHDDVAAIWYFGSAVGSAMVERASAGNLKAAWVNNGRQPDWLDRTQWQGRDYLRRAIQVKNIWVPYGA

SEQ ID NO: 7395 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAAITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 7396 - protein, 182 aa, Cichorium intybus
  unsure (1)..(182): unsure at all Xaa locations
MDPYKQRPSSAYNSPFWTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEXWRILDFLSHHPES

SEQ ID NO: 7397 - protein, 460 aa, Euglena gracilis
MAVGSSMSATTQMHVQPAVRATTRVQPTLAMRGQISRLAANSQVYAEAPAAYEFQAPAQASGVSSGIAAMVMAPVAAAAAFFAYKKGQSDAQTYEVADPAGVQTYGTELVFAMNATIGNKYPGNSNTKAAISGFGRIGRNVLRCWYGRNPKPFDIVAINAGSMSPEQAAHLLKYDSVLGTFEADVQYGDDWISVDGKKLKLLTTRDPAQAPWKELGVEIVIEGTGAFNSLDGSSKHLTAGAKKVVITAPGKNCPTYVCGVNEDQYNPATDHVISNASCTTNGMAGVCKVLDENFTVQYGTMTTTHSYTGDQMILDGRHSDLRRARAGAVNIVPTSTGAAKAVALVLPNLKGKLNGIALRVPTPNVSIVDLVVKVDKKTTKEEVNAALKKAADGPLNGVLGYTELPLVSSDFKGTNVSATVDGQLSMVMGEDMVKVVMWYDNEWGYSQRVVDLTAVVAGKL

SEQ ID NO: 7398 - protein, 321 aa, Agrobacterium tumefaciens str. C58
MTSKLEQLRAITTVVADTGDIEAVARLKPVDCTTNPTIVLKALGTPAFADAVKEAVAWGRKQGGQSDAVVAAVADRLAISVGAALAGLVPGRVSTEVDADLSFDTQASITKARHIIASYKERGIERERILIKLASTWEGIKAAEVLQSEGIDCNLTLLFSQAQAIACAEAKAFLISPFVGRILDWYKKSTGETYTAETDPGVVSVRSIYNYYKANGIGTVVMGASFRNVGEIEALAGCDRLTISPALLEELDKDNGKLERKLSPDNVKAEALQSLDEKAFRWAMNEDAMATEKLSEGIRLFAKDLVTLREMVRKELTAAAA

SEQ ID NO: 7399 - protein, 128 aa, Pectobacterium carotovorum subsp. carotovorum
AVTCPKACIGIITNPVNTTVAMAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAARG

SEQ ID NO: 7400 - protein, 372 aa, Triticum turgidum subsp. durum
MGAEAEQQQQQLPLPFPQAGKADPPAVVGLQVSALIDHVARVDWSLLDRVPGDRGGSQQVSFEELDHILNEVNALILPSHDDPSPVRTMAGGSVANTVRGLSAGFGISTGIIGARGDDDQGILFVNNMSFSGVDLTRLRAKKGHTAQCACLVDASGNRTMRPCLSSAVKLQANEFTKEDFQGSKWLVVRYAQQNLAQIIEAIRVAKQEGLSVSLDLASFEMVRDYKSQLIALLETGNIDLCFANEDEAREIIGGGLTYDPEDALAFLSKHCKWAVVTLASKGCIAKHGKQVVQVPAIGESNAVDATGAGDLFASGFLYGLVKGLPLEECCKVGVCSGGSVVRALGGEVRPENWQWMYKQMHAGGLLLPELKN

SEQ ID NO: 7401 - protein, 665 aa, Glycine max
KSRRQLALFPPSSGAYFFHGFVTSVYSVFVSIFMNTLGKSCLCKSDVQLSLSCRTEGINSRTNSNGTFRKLEKLSRATVIAKSSRLWGFFIACQWVSIVTFPVLWRSYKQLSWLGAKSSPYYQPMHEQFAIVVRDIPHVPQGQTRKEQVDSYFRDIYPETFYRSMIVTDNKVVNKIWESLEKYTKKLARAEAVYAGSKTTAKPEGTRPTNKTGFLGLVGKKVDTIEYCNEKINELEARLESEQKVTLREKQQDAAVVFFSSRVVAASASPNLHAQIPNMELIFRAYIPPRLRWEKIDDDRVEDALSQCSRTAPVGCNYLNFNLFLRVRCSLVEILLDVLLIVHIKPIVNIKALKTVLEAYLPQLALIIFLALLPKLLLFLSKFEGIPTESHAVRAASGKYFYFTVLNVFIGVTIGGTLFKAFKRIREHPTLDEISSLLAESLPGNATFFLTYVALKFFIGYGLELSRIVPLIIYHLKRKYLCKTEAELKEAWRPGDLGYGTRVPGDMLIVTIVFCYSVIAPVIIPFGALYFGLGWLVLRNQALKVYVPTFESYGRMWPHIHNRILASLILYQITMFGYFGTQKFYYTPLVLPLPILSLVFGFVCAKKFYPAFQHPALEVAANTLKEVPNMELIFGAYIPPSLRSEKIDGDRVEDALSQASRTTPV

SEQ ID NO: 7402 - protein, 488 aa, Chordaria flagelliformis
MPEDVQNRTRIKSERYESGVIPYAKMGYWDADYNVKETDILALFRITPQPGVDPVEAAAAVAGESSTATWTVVCSDLLTACDIYRAKAYRVDPVPGTSDQFFAYIAYECDLFEEGSLANLTASINGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 7403 - protein, 458 aa, Methanopyrus kandleri AV19
MRVLSEYKGKAGELLREHGLSVGDRVRIVRDDGVVVEGIIMPRSELGDDEHIVVKMDNGYNVGVRVDRIEKLEAPGEGHEPSFKPMEGEIEYDPKLPNVSVMSTGGTIACRVDYETGAVKPAFTAEELVGAVPELLDVINIVDARAVLDLLSENMEPKHWMKIAEEVVDALSDPDVEGVVIGHGTDTMAFTAAALSFVIEGLNGPVVLVGAQRSSDRPSSDAASNLIAACAFAGDGEVGEVTVCMHGWTSDEVCLVHRGVRVRKMHTSRRDAFRSVESIPIAKVDVKDLRNPKIEFLRSDYRRPEDGEPEISGGFEEKVALVKFAPGMDPEVLDFYVDRGYRGIVLEGTGLGHVSEQWLESIERAVDDGIAVVMTSQCLYGRVNMNVYRTGRLLRAVGVIPGEDMLPEVAYVKLMYVLDRTDDIKEVERLMRTNIAGEIEGGRVLGGFEPADGPHHRL

SEQ ID NO: 7404 - protein, 379 aa, Prochlorococcus marinus str. MIT 9313
MGSSPARMSSGAPAPRVEVECLKAYSAPLEGRRGLLRLDFNENTIGPSPRVLEALRAIPADQIAVYPEYDGLREAVVANLSNRDQGRPGLTQPLSPSQIGLFNGVDAAIHAIFHAYGDRGDRLLTTSPTFGYYTPCAQMQGMKILAIPYEGSDFRFPLQVIRTLLQQKRPRLLLLCNPNNPTGTRLAPEQILELAVAAPETLVVVDELYEAFTGDSVLPQADFSVTPNLLVLRSLAKTAGLAGLRMGFAIGSADVIDRVSRVTGPYDINSFAVTAAFAALDDQAYVDAYVADVLKARDWISARLDASGVPYHLDGGNYLLIWPQQQPTEVEAALRKRGILVRLMTGKPLIDGSLRVSIGTIEQMQQFWQAFATVESLAA

SEQ ID NO: 7405 - protein, 117 aa, Zea mays
EFGTRAVQRVAKAINFKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 7406 - protein, 514 aa, Triticum aestivum
  unsure (1)..(514): unsure at all Xaa locations
MANLVQELMLETPPRAWFLFLLPLLLLSLHHWFTRKTGSTGQRLPPSPPALPIIGHLHLVGALPHVSLRDLARKHGPDVMLLRLGAVPTLVVSSPRAAEAVLRTHDHVLASRPRSVVSDVIMYGSSDIAFAPYGEYWRQARKLVTTHMLSVKKVQSFRSAAAEEVSMSMAKINEAATASGTVDMSELLNSFSNDMACRIVSGKFFLKDGRSKLFGELINDTSRLLGGFNLEEYFPALGRVGVLKRAVCAKAERVRNRWADLLDKVIDDRVSKRKSASDHKDGDFVDILLSVQQEYDLTREHMKALLTDVFFGATDTSANALEFTLAELMRKPHLMLKLQDEVRSIIPRGQEIVSEADMNNMXYLRAVIKESLRLYPVAPLLAPHLAMADCTIHGYMVPAGTRVVVNAWAIGRDSSSWEDAEEFIPERFTDEGNATNVNFKGNDFQFLPFGAGRRICPGINLGIANVELMLANLVCHFDWELPVGVERKDIDMTEVFGLTVRRKEKLLLIPKSRM

SEQ ID NO: 7407 - protein, 518 aa, Neurospora crassa
MGLGLKLPTIYNVHLVAIIATLGGALFGFDISSMSAIVVTDQYLTYFNNPHDIIQGAIGSALAAGSVVGSAIAGPLSDKIGRRDSIFFACFFWLIGTSVQVACKNYGQLIAGRVLNGFTVGITSSQVPVYLAEIAKAEKRGSLVIIQQLAIEFGILIMYFIGYGCASIEGPASFRTAWGIQFIPCFFLMVGLPFLPRSPRWLAKVGRDQEAIAVLANIQADGNVDDPRVVAEWEEIVTVMNAEREAGKGWRKFVKNGMWKRTMAGMTVQAWQQLAGANVIVYYLTYIAQMAGLTGNVAMVTSGIQYAVFIIFTGVMWLFIDKTGRRTLLVYGALGMAFCHFVVGGVMGAHHDNVPDGVGGNANIVISVHKGAPANTVILFSYLLIVVYALTLAPVCWIYAAEVWSLGTRATGMSMAAMSNWVFNFALGMFTPPAFVNITWKLFIIFGVLCVTAAVWFWLFYPETCGKTLEEIEILFGDQGPKPWKTKKGESRLTAEIEAVKARKTVEHEIEVHEHEKV

SEQ ID NO: 7408 - protein, 358 aa, Photorhabdus luminescens
MSKIFDFVKPGVITGDDVQKVFAIAKENNFALPAVNCVGTDSINAVLETAAKVRSPVIIQFSNGGAAFIAGKGLKVEGQQAAILGSISGAHHVHQMAEHYGVPVILHTDHCARKLLPWIDGLLDAGEKHYAATGKPLFSSHMIDLSEESLEENIEICGKYLARMAKIDMTLEIELGCTGGEEDGVDNSHMDSSALYTQPEDVAYAYEKLNAISPRFTIAASFGNVHGVYKPGNVKLTPKILRNSQDYVSEKFNLPHNSLDFVFHGGSGSTAEEIKEAVSYGVVKMNIDTDTQWATWEGILNYYKKNEGYLQGQLGNPEGADKPNKKFYDPRVWLRAGQVSMIARLEQAFKELNAIDVL

SEQ ID NO: 7409 - protein, 519 aa, Enterococcus faecium
MEKKGKIKKLDKTQIYFILKGIFVGLLTGIVVSLFRLSIEKLSDLVRSIYEMSREQPIYLIGLAICCILAAFFVGYLVKNEPDIKGSGIPQVEGQLRGELSMNWFSVLWKKFIGGVLSVGAGLFLGREGPSIQLGASIGQGAGQLFRSPSSEEKILISSGASSGLAAAFNAPIAGLLFVLEEIHHSFSPLVWLTSFASAITANFVSLYFFGLRPVLYLGDLPSLPLKYYGSLVILGVLLGILGFIYQNVLLALPKFYNRLPLPAYFHGFVPFLLILPIGYLWPSTLGGGNQIVLAFGHASLPIIMIIGLFVLRFVFSMISYGGGLPGGIFLPILTLGALIGSFYGNIMVDFGMDPIYIKDFVVIAMAGYFTAIGKAPLTAIILVTEMVGSLNHLMPLGLAALVAYIVNDLLGGNPIYESLLERLLGNTQTASLKGARTTFDFPVTAESSLDGLMVRDFNWPKNMLLISIRRGNQEILTHGDTIMNVGDILVILTDEANLPRIKQEIEAKSSITNLKQSF

SEQ ID NO: 7410 - protein, 463 aa, Enterococcus faecalis V583
MSIFRKKEITVPVNDSGGMKKNLKTMDLIFLGIGAVVGTGIFVVTGVAAERYAGPGLVLSFLVAAAAIILSGLCYAEFASRIPVIGGPYAYMYVVFGEIVAWMTGWMIICEFFLAVSSVASGWSGYVHGFLDSLGFSLPQALSGAYNPTNGTYIDLIAMLVVVAVTFWVSLEAKTALRLNNLMVFVKFGIILLFVLVGIFYVKPTNWQPFIPYGFSGVFSGAALVFFAFLGFDAVSMAAEEVKNPKKDIPKGIIGSIIISTLLYIVVTLVLTGIVPFTDLGVKDPVAFAMRFINHGAIATIISVGAILTLLTVTIAMMYSLARVIYAISKDGLLPQFMSKIDEKRHTPKNATYVAGFLAMVFAGIVPMEMLAELTNIVTLFYLMFLALGIIKLRTMKGEPQAGEFKVPLVPVLPLISIVVCAALMFQLSLATWQVFGVAVVIGLAIYFFYGRHHSIVRFETKE

SEQ ID NO: 7411 - protein, 214 aa, Schizosaccharomyces pombe
NFTEFNDEGEVWFGEEAEERIVQWLEDHISTSFREVSEAAPFRVLDLGTGNGHLLFRLLEEEDTLLPSPCQLVGVDYSEAAIVLAKNIARHRQFSDKVKFQQLDIIKDSKFCSKDWDLILDKGTFDAISLSGELLDGRPLNSVYVDRVRGMLSPNGIFLITSCNWTIQELEERFTKNGFIVHSTVPVPVFEFQGSTGSSTSVIAFQIDPSFNRK

SEQ ID NO: 7412 - protein, 389 aa, Zea mays
  unsure (1)..(389): unsure at all Xaa locations
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTXGNLQDNFFASFALGWLITNGAGLASYPIDTVRRRMMMTSGEAVKYKSSLDAFQQILKKEGPKSLFKGXAGANILRAIAGAGVLSGYDQLQILFFGKKYGSGGA

SEQ ID NO: 7413 - protein, 486 aa, Oryza sativa
MAAAGAYSASLPAVPDWLNKGDNAWQLTASTLVGIQSMPGLVVLYGSIVKKKWAVNSAFMALYAYASSLLVWVLVGFRMAFGDQLLPFWGKAGVALTQSYLVGRATLPATAHGAIPRTEPFYPEATLVLFQFEFAAITLVLLAGSVLGRMNIKAWMAFTPLWLLLSYTVGAFSLWGGGFLYRWGVIDYSGGYVIHLSSGIAGFTAAYWVGPRLKSDRERFSPNNILLMIAGGGLLWMGWAGFNGGAPYAANIAASVAVLNTNVCAATSLLMWTCLDVIFFRKPSVIGAVQGMMTGLVCITPGAGLVQTWAAVVMGIFAGSVPWFTMMILHKKSALLMKVDDTLAVFHTHAVAGLLGGILTGLLATPELFSLESTVPGLRGAFYGGGIKQIGKQLGGAAFVIAWNLVVTTAILLGIGLFIPLRMPDEQLMIGDDAAHGEEAYALWGDGEKFDATRHDLSRGGGGGDRDGPAGERLSALGARGVTIQL

SEQ ID NO: 7414 - protein, 201 aa, Brassica rapa subsp. pekinensis
PGTDTAAAVVVWAMTYLIKYPEAMKKAQDEVRNVVGDKGYVSEEDIPNLPYLKAVIKESLRLEPVIPILLHRETIADAKIGGYDIPAKTIIQVNAWAVSRDTAAWGDNPNEFIPERFMNEQKGVDFKGQDFELLPFGSGRRMCPAMHLGVAMVEIPFANLLYRFDWSLPKGIKPEDIKMDVMTGLAMHKKDHLVLAPRTHI

SEQ ID NO: 7415 - protein, 344 aa, Burkholderia fungorum
MPGEQPVVTHPVKLNTNENPYPPSPRVLEAIRQELGDAAESLRRYPDPTAQKLRETVAAYHGIRAEQVFAGNGSDEVLALTFQALLKHDKPLLFPDVTYSFYPTYARLFEVDYRTIPLDDSFTIHVDDYMSPNGGILFPNPNAPTGRPLPLADIERLVASSPDSVVVIDEAYVDFGAQSAIGLIDRYPNLLVVQTVSKSRSLAGMRVGFAFGNPDLIGALNRVKDSFNSYPLDRLAQAAAAAAYEDDAWFRDTCAKVVASRERLAAGLTALGFEVLPSAANLLFARHEGYDAATLALRLRDKEIFVRHFKAPRIDQHLRISVGTDAECDILLDALRDIFSAYVG

SEQ ID NO: 7416 - protein, 862 aa, Neurospora crassa
MDNDTTAAPKPSSGPTNTTTTIRIEEPSFPPKDTNDPDRARDREPATGVSTGVNFRSRGSSMSSCHRPELVGGVFNPRSIISRGKRPADSRSSHDNGTSQSHLDIEEGDDWRGGYEKKKQVFKGRTLLWLAYQSVGVIYGDIGTSPLYVFSSTFTAPPTHRDLLQVLSVVIWSITILVTFKYIFVILHADNEGEGGTFSCYSLLTRFANITERDPREEVTVRMERHLTNDLKPPTRSLRAKLEGSRFTHVLLKIIGVLAVSMVMSDGVLTPAQSVLGAVQGLSVVKPDISKSTVTGTTCGILVLLFLIQPLGTSKIATTFAPIVIVWLGLNFSFGIYNLVTFDWTVLKAFSPYFAFQFFIEHKTRAWKMLGGVLLSFTGVEALFADLGAFSLHAIQLSWMCYTYPCLLLAYIGQAAYISHHPDAYTNPFFNAAPPGTLYPSLVIAILAAIVASQAMITATFQLISQIMKLSYCPQVKVVHTSQTFHGQIYVPFVNWLLMLGAILVTAVYGDTVKLGNAYGVCVMFVTFFDTCMVTLVSLIVWKLSPFLVFVPWLVFASVDGLYLSAALIKVPEGAWFTLTLSGILTSLFLLWRFGKENQWRAEAEDRFKPSHLIVKDKNEGGRLRLQPVWGGDPLSSLRGFGIFFDKTGVMTPAVFTHYVTKFVAIPEVAVFFHLHPVEAPTVLPEERYAVSHFTAVPGCYRLVIKHGFMDQVISPDLAALIYEQIRRFVVRQATERMRALEKLRTGEDTDCEGEGEQEAAKGETSHRTESSGASGPDGVLLPVELRDEEAAAELARLDRAYASKILYVVGKEQMRIKTGAPIARRFMLSVFLWIRDNTRAKIANLQLATDRLVEVGFVKEI

SEQ ID NO: 7417 - protein, 380 aa, Listeria ivanovii
QNRWRPELHDIQVSGIRAFNTRVTGIPDMIRLTLGEPDFPTPEHVKQAAIQAIQDNFTNYTPNAGMPELLEAASTYFQEKYNLEYNTNEIIVTVGATEAISVALQTILEPGDEVILPDPIYPGYEPLITLNKAHPIRIDTTETNFKLTPTQLRKHITPKTKALIIPYPSNPTGVSLTKEELVDLANVLREAGIFVIADEIYSELIYHEEHASIAPMLREQTIVINGLSKSHAMIGWRIGFLLAPEIITKQMLKIHQYSVTCASSISQKAALEAITNGKDDAFQMRTEYKTRANFTQDRLEKMGFTVVPPDGAFYFFVKLPDEITENSFDWAVKLAEEAKVAVVPGNAFSEKGDRFFRLSYATSFNKLAEALDRMAAFLSK

SEQ ID NO: 7418 - protein, 491 aa, Bacillus cereus ATCC 14579
MKIKAQVGMVMNLDKCIGCHTCSVTCKNTWTNRPGAEYMYFNNVETKPGIGYPKQWEDQEKYKGGWELKNGEIQLKSGSKMKRLMNIFHNPDQPTIDDYFEPWNYDYETLTNSPQRKHQPVARPKSAITGEFIDKIEWGPNWEDDLAGGHITGLQDPNVKKMEEEIKTDFENVFMMYLPRICEHCMNPSCVSSCPSGAMYKREEDGIVLVDQIACRAWRFCVSSCPYKKVYFNWQTNKAEKCTMCFPRIEAGMPTICSETCVGRIRYIGVMLYDADKVKEAASVEDKKDLYESQLTVFLDPNDPEVAAEAKKQGIPEEWIKAAQQSPIYKMIIDWKIALPLHPEYRTMPMVWYIPPLSPIMNMVEGKGSNWQAEEIFPAIDNMRIPIQYLANLLTAGDESHIRLTLKKMAVMRTHMRAMQINKEPNEAVLKELGLTKQDVEDMYRLLAIAKYKDRFVIPTSHREQVADLYSEQGSCGLAFAGGPGSCMTIS

SEQ ID NO: 7419 - protein, 459 aa, Streptococcus pyogenes M1 GAS
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIIFGIYSNVKFK

SEQ ID NO: 7420 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 7421 - protein, 223 aa, Klebsiella oxytoca
APVTPGVAVDLSHIPTDVKIKGFSGEDATPALEGADVVLISAGVARKPGMDRSDLFNVNAGIVKNLVQQIAKTCPQACVGIITNPVNTTVAIAAEVLKKAGVYDKNKLFGVTTLDIIRSNTFVAELKGKSSSDVEVPVIGGHSGVTILPLLSQIPGVSFSEQEVADLTKRIQNAGTEVVEAKAGGGSATLSMGQAAARFGLSLVRAMQGEKGVVECAYVEGDG

SEQ ID NO: 7422 - protein, 197 aa, Schizosaccharomyces pombe
MAPKTNLQISVICASNQNRSMEAHNVLKNAGYQVDSFGTGSAVRLPGPSIDKPNIYQFGYPYDEIYKELEAQDSRLYTANGLLKMLDRNRRIKRAPCRWQDQDSIYNIVITCEERCYDAICEDLYRRGETLNRPVYLINVDIKDNHEEASVGGKAILDLVNKLTEAQDKLEELFPSIMADFQSNHPKLPVLYTIHFF

SEQ ID NO: 7423 - protein, 445 aa, Oryza sativa
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 7424 - protein, 825 aa, Saccharomyces cerevisiae
MENTLGEGSTVNASVDVDQHGNDNNSDSNANAAVAGVANTDTAGEESQQQDESLKDEATVPNTRDAESEAITVTAKQQPTMQANKLDSQETPSTEESRAQNVFGQDNEDSDNLFGETESSVSNNEANTPSIPTNPVDNENNKPAIKEDSTIQDSNGDVKNMEDVKIQKEEEPENNTVIEGVKEESQPDENTKEMDEVEEDDEDDDQPMISPDNSIFGDTKSESKQLGNTSSVANTPSEIPDAHKAEQEDIIEKTESVDKKVDSGEERNEQEREIMNDHSKSANPKKTTITRVEPETFEIPQAHEIVIPSYSKWFNLEKIHSIEVQSLPEFFTNRIPSKTPEVYMRYRNFMVNSYRLNPNEYFSVTTARRNVSGDAAALFRLHKFLTKWGLINYQVDSKLLPKNIEPPLTSQYSTRHDAPRGLFPFESYKPSVQLPDMAKLKKMMNTSDSESTLYKYLKESKRKYDEITHPPSTTDDENGDKNDNGGKMNNEVSTSTSMTGDANLLEEGETSRPLKKVKILEQIDENWSKEDLQKLLKGIQEFGADWYKVAKNVGNKSPEQCILRFLQLPIEDKFLYGDGNGKGDNDNGLGPLKYAPHLPFSKSENPVLSTIAFLVGLVNPKTVQSMTQRAIQSAESIKSQKEEISDQKPIEHIKEGSEIAISSLGYRSHIFATNEERQMNFLTNELIRLQMEKLDAKLNHLKKLEKFMELERKTLERQQENLLIQRLNFNQNSSKIVNVLSKCLNLISDSNINNSSVAEKEEIRSQIDHFKSMLSKPETLSIGKNPFNKPNIETGENHNGQSISNENDVKPISIEAPQFYRYWSA

SEQ ID NO: 7425 - protein, 228 aa, Oryza sativa
MAAAAAAKIAPSMLSSDFANLAAEADRMVRLGADWLHMDIMDGHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGEVISALRKSVEGSQNKS

SEQ ID NO: 7426 - protein, 107 aa, Triticum aestivum
TYPWEVLFSIAICILGLILFALLIGNMQTYLQSVAIRLEEMRVEKRDAEQWMHHRSLPPDIRERVRRYERYRWLETRGVDEENLIQTLPKDLRRDIKRHLCLGLVKR

SEQ ID NO: 7427 - protein, 209 aa, Triticum aestivum
  unsure (1)..(209): unsure at all Xaa locations
AFPTPPRSANHRLLLPPPFSPLRSSPPARAFFIRVSGRGMADDDSGSPRGGGGVREQDRFLPIANISRIMKKAVPANGEIAKDAKETLQECVSEFISFVTSEASDKCQKEKRKTINGHDLLWAMATLGFEEYVDPLKIDLQKNRDMEGDSKLTAKSGVGSMKKERIGEQSRATSSNGQAMSNAQAMVQHGGYAQGMGYIQPXQYHNGDT

SEQ ID NO: 7428 - protein, 178 aa, Schizosaccharomyces pombe
MSLSMNFFTAHLSIAIAITKGNSEIARIYASNAIRKQQESLNLLKLSSRIDAVSSRLQTAVTMRAVSGNMAGVVRGMDRAMKTMNLEMISQVMDKFEAQFDDVNVQTGYMNKAMGSVTAVDTPQEDVDLLMQTVADEAGLEFNQNMNNNLSVPAASVPTPAAPVEDDNLQERLRALRS

SEQ ID NO: 7429 - protein, 1062 aa, GIBBERELLA ZEAE PH-1
MSVDSLLSSLASSYNRVQLHLSYFARVYRASCASATVMSSNWHSLIARAIDIPLEGDDSRVGSTRDGSSGGTLSTNNASKSSSLQSLGGTFIPVVIYCVVCIIFFSIFRVKCSRVYAPRAIPSLRSPHKHIPPLPTGWFDWVKPFFKTPDTFVLNHGSLDGFFFLRYLKVLRNTFLVGMLIAWPILFPIHITGGNKLSQLDILTIGKISDRKRFVLFTITRECFYYIGIRQAYLSSPHYSKRLSSRTVLITSIPDRYLDEARLRKLYGDSVKRVWIPRTAKALIKLVEEREETAMRLEKAEIALIKKAHLARKKHFNKSPSSASSSVDPYPTESSSSYRSDPSSEQTRSDSPRVGVSQNETAQDETQEAGFKAQYPQVTQTVTQDTHDLLERSAEDPEYVHPYGLNPNLPDVRGSVAAQWIPAKARPHHRPLQNFFRRVDTIRWCRMRLKDLNLEIYKLRRQVRRGDGDTLPAAFIEFDTQEAAQAAHQIVAHHRPLQLAPRLLGVRPDEVVWKALRMCWWERIIRRFLIMGLVAVAIIFWSIPSAMIGIISNIDFLSGIVFLRWIKLLPKPILGFLQGFIPAIALSFWMSLVPAMLRFCGVQAGIPSLVLVELFTQNIYFAFQVVQVFLITTLTSAASAAVLDIIKQPMSAPDLLARNLPKASNFYLSYILVQCLAIGATGLLHLFELFRQHILGRGLQNPRTRFNIWYNLRPPRWGGIFPIYTNMACIAFCYTCIAPLILLFACAGMAFTRLIYRYNILYVFDSEMDSMGLFYPNALLQLIVGLYLAEICMIGLFALKLAFPPMVLMLIFLIFTGIVHMSLRDSISPLLQNLPQTLTLEEELQQQEKAEAEQKLQEAAESGEVNGGTAASYFDADLNFGEEEVEEPPSDDEDGQHDGPQGSRGVDGGGGVKLMVREWMKTTAKAQVKKEIQQSGIKRFLDRWILAGDPSNPDQQPTFLQRFLHPEVYEDFIALRKLIPFEEPPDVDYAGDEKMSNYWPPELWMPKPVLWIPRDEARVSRQEVAHTRKITPITDVGVTLNEKGLIIVDVEAAPFPRMRLVH

SEQ ID NO: 7430 - protein, 587 aa, Streptomyces avermitilis MA-4680
MHPCSPRLVGVPAPDRFGVLMGTQWNAVDGRIRTTARGHAVLNSPRLNRGTAFTRQERQELGLVGLVPPQVLTQDQQAARAYTQFRSQPNDLAKNVYLTALRDRNEVLFHRLLGDHLAEMLPIVYTPTVGTAIERYSYEYRRPRGVYLSVDAPEDIERTLRASGLGADDVDLIVATDGEAILGIGDWGVGGIDIAVGKLAVYTAAAGVDPARTLAVMLDVGTNRQELLDDPLYLGNRHPRVDRESYDAFIDAYVTAATELFPDALLHWEDFGPANARRILDRYREKVRTFNDDIQGTGAVNLAAVLSGVRAGGVPLRDHRVVLFGAGTAGIGIADQLRDALIADGLTPQEATDRIWAVDRHGLLAEDQQGLHDFQLRYVRRGAEIAGWRRDDALGGVPLAEVVDRVRPSVLIGASGQGGAFTEDIVRAMAAHTDRPIILPMSNPTRLAEAVPADLLTWTDGQALIATGSPFDPVEVDGVTHHIGQANNALVFPGLGLGAVVARAERITDGMLVASARAVAEQTDATAPGVPVLPLIDRLRDTSAAVAVAVARAAVEDGVARETVDDAVEERVRAAMWQPEYPPIEAV

SEQ ID NO: 7431 - protein, 643 aa, Glycine max
MRKRSDESTLPGSNPFTTRPGFPIDEAKRGSLGKFSRMLKRLLNDLEVRQIMKAERFCEANQLPPEYVCVNGHPLSYEELVTLQNCPNPPKKLKPGTYWYDKVSGLWGKEGQKPSQIISPHLNVGGPIQQDASNGNTQVFINGREITKVELRMLQLAGVQCAGNPHFWVNEDGSYQEEGQKNTRGYIWGKAGTKLVCAFLSLPVPSKSSNSLGEQPSSLASRTMPDYLEHGIVQKLLLVGGSGSGTSTIFKQAKILYKSVPFSEDEHENIKLTIQSNVYAYLGMLLEGRERFEDESLGDLKKRQSSVHDTTGTSPKLDEKTVYSIGPRLKAFSDWLLKTMVSGKLDAIFPAATREYAPLIEELWNDAAIKATYERRSELEMLPSVASYFLERAVKILRTDYEPSDLDILYAEGVTSSNGVACVEFSFPQSVSEETVDTTDRYDSLVRYQLIRVHARGLGENCKWLEMFEDVEMVIFCVSLTDYDQFSVDGNGCLTNKMILSRKFFETIVTHPTFEQMEFLLILNKFDLFEEKIEQVPLTKCEWFSDFHPIISRNRPNGNSNSINNNPSLGQLASHYIAVKFKRLYSSLTGRKLYVSPVKGLEPGSVDASLKYAKEILKWSEERPNFSLSEYSMYSTEASSFSH

SEQ ID NO: 7432 - protein, 556 aa, Mycobacterium tuberculosis H37Rv
MPDDIAAADPTDTQPHLRRDLANRHIQLIAIGGAIGTGLFMGSGRTISLAGPAVMVVYGIIGFFVFFVLRAMGELLLSNLNYKSFVDFAADLRGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 7433 - protein, 515 aa, Oryza sativa (japonica cultivar-group)
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSADRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 7434 - protein, 471 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGI

SEQ ID NO: 7435 - protein, 347 aa, Streptomyces avermitilis MA-4680
MTTTVAAYAAPAAKAPLERTTIERREVGEFDVLIDIKFAGICHSDIHQARDGWGEGIFPMVPGHEIAGIVAEVGSGVTKFQVGDRVGVGCMVDSCRECENCKAGLEQYCVGGNVGTYNALDKNGEPTYGGYSEKVVVDENYTVRIPDGLALDVAAPLLCAGITTYSPLKHWNAGPGKKVAVLGMGGLGHMGVKIAHALGAEVTVLSQSLRKKDDGLKLGADHYYATSDPKTFEELAGTFDIILSTVSAPLDFGAFLSLLRTDGALVNVGAPEEPISINLFSVIAGRKTLAGSGIGGIQETQEMLDFCAEHGLGAEIELISASEINDAYERVLNSDVRYRFVIDTATI

SEQ ID NO: 7436 - protein, 1229 aa, Neurospora crassa
MPNGSRISKNQPRSLTDEHALGMNTSRPTTSPAAAVVNRSSDPDPVPDPAARHKPNPDRPGASDGPSKSGKPRGRSIEPPSSSPQPAPRHRHPSRHRSPDRSGRSSRLPHRSRGSPRSRRDRSREPRGRDGHFPPDRRHRSPVLPRGRGDAAHERGQNVDHGKHHSQLPPHPARASQRGSSRTPGSSKRRRSRTPSPGGPDSKKSRRGRSPRRGEKDDVNSLQLPRDCRRSPVDRRPSRSPSHHERRRSRDRKRSGRSRSPDRSRRRKSRSPDRGVFDRASGRVRRRSPSPRHRGRSDRPDRPERRHQSKSRSRTPPHRENRHPASDAGSRRRPSPDPDSREPYDHPQGSPRDRRRSKSSKKGKVRDDQKFDPASGVNSIEVNMAARNGYRGGYGAPMPPGYTETHDGRNYSHSSGHATPNSSFHGSPPAQSPYGAGRGWNNPQFSPQSQYGYPHGNYGPPTGPQAHYHSNQGHSPPYPPTGPAAQYPTGPFRGGHRAASGGFRGGSFGVARGGHRGGSKNAQWSPNAHNARGQYITPTTTITTATDNNPAHAQNNAAPSKYADSGQNTQEGTREDVNSSSRPDKDLQGDDTNSSGKEKEEQMQPPTRPAAASQSQPSNKFSFSMKNATKPVVAAPRPEISLKFNAVVPPREPSQKQPPKAPAAAPPTAPSAHRSNRDRHDLPKNVPTEPASARARHNDRRGPDPHRPVDSHRPVDSHRPVDSHRPAEQQKPRTRIVKKIVKKLKEKPALPPDLAKSKSVYHRKPGNESVIGSGTYGKVFKALNVYTKKQVALKRIRMEGERDGFPVTAVREIKLLRSLSHRNIVKLMEVMVEMNECFMVFEYLSHDLTGLINHPNYTLDPAQKKHLALQLFEGLDYLHTRGVLHRDIKAANILVSNEGVLKLADFGLARFYAKHHQLDYTNRVITIWYRSPELLLGETQYGPAVDIWSAACVMMEIFTKRAIFPGDGSEINQLDKIHSVLGTPTRNDWPNIIEMPWFELLRPTQRRANVFAEKYKELVTPAAFELLLWMFKYDPDKRPSAAQVLAHPYFTTEEPAPRQAVELKDIDGEWHEFESKALRKENERKEREARRAVKDGAPAAAAAPSGGGGSSSTREKDRDPRKRPAESREPPPSERDSKRPHLDSHAANKPSTILSSSAPPPPQQQQREPERSSVPTRPREQHQQEQQQEQQQCRPSASSSSHLPPAQAQARARAPTNAPSGPAASQSHN

SEQ ID NO: 7437 - protein, 223 aa, Glycine max
SYVGPPPDLSEESDDENIATCVKYFERMSKIGIWLEMEIGITGGEEDGVNNEHVKKEALYTSPETVFAVHKALSPISPNFSIAAAFGNVHGVYKPGNVVLKPSILGDHQAYAQKQTDSKTPHPLFLVFHGGSGSTQEEFDIAIKNGVVKVNLDTDCQYAYLTGIRDYVLNKKDYLMTMVGNPDGEDKPNKKYFDPRVWVREGEKTMSKRVAEALHIFHVEGQL

SEQ ID NO: 7438 - protein, 107 aa, Oryza sativa
  unsure (1)..(107): unsure at all Xaa locations
MGEEKVAPKSDAAPAVELLGFVMSAEEAERAAAAAGVETVEDLLPLLVPSAMRRARAPISRFPVGAVGLGASGRVYAGVNLXEFRGLPLSHSXVHAEQFLVVNAAAA

SEQ ID NO: 7439 - protein, 355 aa, Schizosaccharomyces pombe
MNPTTKRAIKEIVVYALAFGCSWYAAHKLLSTLDPYRQKRQDTVSKSRKRLDEWAGEQVKELETLELNEYEQIVASQLVLPSEIDVSFDDIGGMDEHVNQLLQDVLFPLKYPEVFDTHGGLLSCPKGLLLYGPPGCGKTMLAKALAKQSQATFINVSVGLLTDKWFGESNKLVDALFTLARKLEPTIIFIDEIDTFLRQRQRTDHEAMAQIKAEFMSMWDGLLSGQSRVLVLGATNRPADIDEAIRRRMPKVFSIPLPNAEQRRKILELYLKKVPLEANFDWNGVVNATAGLSGSYIKEVCRSALSVPRRELFDKHGNDLEAIKYDIQSGGLRSLKTEDFYHYESLQNVSGIDVE

SEQ ID NO: 7440 - protein, 354 aa, Glycine max
MPVVTEHMKWRRPRNQFRHPISETDDPNPQIPSIIQSSHSKSTFSSLFSSFSTSNETRDQNRNNNNKSNRKFSAATFRGFGCTAGASQKVSVPVPAVIRSSADREGKSSRKKKHRRNSNSGNSTSDDDDDDVWCGPGIGFSTDAAAASVECVVARKNVSARGKLDVVEDRVTHRERSSYFGRRTVKPESFSFLEDEPDIFAARPGLEPFGTARFYRHVPHPSPDGLAEIMILQGRIMMGGRFDSHDQFRDWRLDVDNMSYEQLLELGERIGYVNTGLKEDEMGLNIRKVKPSSSNDASKHQLDKKCSVCQEEYESDDELGRLKCDHSYHFQCIKQWLVHKNFCPVCKQEVVVRH

SEQ ID NO: 7441 - protein, 307 aa, Pseudomonas putida
MTGMPQVLALGEAMIEFNQSTKGAPNYLQGFGGDVSNFLIAASRQGASSGFVSAVGNDHFGQLLLDLWRAENVDTSTVRVDANAPTGVYFVSHGESGHRFDYLRAGSAASRYAVSDLPLDAIAAAQVVHLSGISLAIGVPACDASLAAIDHAKRHGVKVSFDTNLRLKLWPLARARAVMLEAIRATDICLPSWDDVTELTGLADKDAIVDFLLALGPKVVALKLGKEGAYVATPAERRVVAGRVVKAVDATGAGDCFGGAFIARIVAGDDPFAAARYANVAAALSTQGFGAVAPIPDRATVEKALAE

SEQ ID NO: 7442 - protein, 692 aa, Neurospora crassa
MSNQSSLLAKHRHPVPAPLCTSLKARPNSGHAFNLSNFWRLWTNTDNIWTGIRRNKSFHGVAAPSPLLSVELHLLLSPTRRSPGNLRQARNHQCRPTEHQHNLAMLSEVIAGSLAELATENPTKQEMYSAMAIFIFILLLMTAFFTSYIMQERKIQAVHETVVSIFAGMVVGLIIRISGSDNIQSLLRFSPQIFFNLLLPPIILSSGYELHQANFFRNIGTILTFAFAGTAISAVVIGVLLWLYTRIPLEGLEVTFREAIQVGASLSATDPVTILAIFNSFKVDPQLYTVIFGESILNDAIAIVIFESAQHADGNGQRIGVVSIIHGIWYFLKEFFGSLAIGSVVGILAAVLLKFTYLRRYPKMESCMIVLIAYSTYFFSQAIQMSVLSVCAARWLAVFPLSRLINWFIRYRARRHGREAADVLPYNYQAMLFWAGLRGAVGVALAAAFTGKSRFALQATVLVVVVLTVIIFGGTTARMLEILEIKTGVVEEIDSDDEFDIEAIHGGTWHKRSGTGIGFSAPRRGSTVPLGNLDSERNGSPGSRSGWASGHRSPNPMPRRQSSRLDVKNGNDHERVDLLGVSGNNTDSEIGSDIDTSDLPPPAPRRRPSPIPGGGNADLEAGPGERGSGWNRSTSNNEGGQSLSATAAIRQLFSSEDPTALFRQFDENYIKPKLLLDGGTGRGGHGGPSGSG

SEQ ID NO: 7443 - protein, 249 aa, Glycine max
MVDDPMLRSSLPAPRVAQAAMFSLIPEDWGEHVSPWVKEISQYFDCLKSLHFRRMIVKDSDLQNLARDRGHVLHALKLDKCFSFTTDGLFHIGRFCNDKLGLSLELDSFATGVMISTTDLGQHTLEQVEPIRNFFAALFLASIGMLIHVHFLWNHVDILLAVVILVIIIKTIVTISVVKGFGYNNKTSLLVGMSLAQIKEFAFVLLNRASNIHLVKVCASFRDKHFSYFVVHMLMKTVKFIFLYFRKQF

SEQ ID NO: 7444 - protein, 886 aa, Xanthomonas axonopodis pv. citri str. 306
MSSVFVSRLAMAVGLGLTLPCLALATPAKPAGSPEQRAAALVAQMSREEKVAQAMNDAPAIPRLGIPAYEWWSEGLHGIARNGYATVFPQSIGLAASWNTSLMQQVGTVVSTEARAKFNQAGGPGKDHQRYAGLTIWSPNINIFRDPRWGRGMETYGEDPFLTGQMAVGFIRGLQGEDLNHPRTIATPKHIAVHSGPEPGRHGFDVDVSPHDVEATYTPAFRAALVEGQAGSVMCAYNALHGTPVCAADWLLNGRVRGDWGFKGFVVSDCDAVDDMTQFHYFRPDNAGSSAAALKAGHDLNCGHAYRELGTAIARGEVDEALLDQSLVRLFAARYRLGELEAPRKDPYARLGAKDVDNAAHRALALQAAAESIVLLKNDANTLPLRAGTRLAVIGPNADALAALEANYQGTSSAPVTPLLGLRQRFGAQQVSYAQGAPLAAGVPGMIPETALRSDGKPGLRGEYFDNVDMSGAARVVRQDRTVSFNWDQVAPAKGVPADRYAVRWSGELLPPSAGDYTLAVRVARCFDCSGHDPVRLYIDDKLVVAGNAEDKHVPAGMHNADGRSVETVLHFDDTRPRKIRLEMEHRGQDQGVRLEWLAPAAAQLAEAAQAVAQADAVVAFVGLSPDVEGEELRIDVPGFDGGDRNDIALPAPQQALLERAKASGKPLVVVLMSGSAVALNWAKMHADAIVAAWYPGQSGGTAIARMLAGDDNPGGRLPVTFYRSTKDLPPYVSYDMKGRTYRYFKGEPLFPFGYGLSYTRFAYDAPQLSTTTLQAGNPLQVTATVRNTGARAGDEVAQVYLQYPDRPQSPLRSLVGFQRVHLAAGEQRTLTFHLDARALSDVDRSGQRAVEAGDYTLFVGGGQPGTGAAGNAASFSIQGRSPLPK

SEQ ID NO: 7445 - protein, 423 aa, Geobacter metallireducens
MYFNWRKEGTIMYVTGNLAGNTIAMVLAGGKGERLAPLTLRRPKPGVAFGGKYKIIDFVLSNMFNSGIKKVYILTQYRAYSLMKHIRESWGKWAGLGEFFVAISPETSSESEEWFKGTADAINHYLRFIESSDADYVAIFGGDHIYRMDVSQMIGYHRRNRADITIAALEVPVEEARRFGVFCVDDDNRVTAFEEKPANPVTIPGRETCFASMGNYIFSTRRLIEVLQEGKKLHADLDFGKHVIPMMLAKKDRVFAYNFNDNLIPGMKPEERGYWKDVGTIDSYYEANMELIHVSPQLNLYNYKWPILTNQGNYPPAKTVFDEDGRRGMNIDSYVCAGCITSGSVVRRSIVGPLTKVNSYSLVEDSILFENVNVGRNVKIRRAIIDKNITIPDGTTIGYDHGEDRRRGYTVTESGIVVVSPAE

SEQ ID NO: 7446 - protein, 119 aa, Glycine max
  unsure (1)..(119): unsure at all Xaa locations
SEGISRVXRDADNLQXQQLEQXDVLSSVATVLSDLCGPGEWMPMEKLHTELLDQYXXVWHHXXVRRXLTSKXWXPPXSKRKPXXXXLXXLRXXPDXFVINXXSVGRVTPEFVSLVSLIS

SEQ ID NO: 7447 - protein, 334 aa, Leuconostoc mesenteroides subsp. mesenteroides ATCC 8293
  unsure (1)..(334): unsure at all Xaa locations
SLVPVLLIVAVFYLMMNQAGGGKGGQGGMMSFGKSKAKPSDPKDNKVRFADVAGAEEEKQELVEVVEFLKAPKKFVNLGARIPKGVLLEGPPGTGKTLLAKAVAGEASVPFFSMSGSDFVEMFVGVGASRVRDLFENAKKSAPAIIFIDEIDAVGRRRGTGMGGGNDEREQTLNQILIEMDGFEGSEGVIILASTNRSDVLDPALLRSGRFDRKILVGAPDVKGREAILNVHAKNKPLADNVDLKAIAQQTPXXXXXXXXXXXXXXXXXXXXXXXXXXXXXXXXXXXXXXXXXXXXXXXXXXXXXXXXXXXXXXXXXXXXXXXXXXLERIWKTC

SEQ ID NO: 7448 - protein, 314 aa, Capsicum annuum
GINGFGRIGRNFLRCWHGRKDSPLDVIAINDTGGVKQASHLLKYDSTLGIFEADVKPVGTDGISVDGKVIQVVSNRNPSNLPWGDLGIDLVIEGTGVFVDREGAGKHIQAGAKKVLITAPGKGDIPTYVVGVNADLYNPDEPIISNASCTTNCLAPFVKILDQKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFREAADKELNGILSVCDEPLVSVDFRCSDVSSTVDASLTMVMGDDMVKVIAWYDNEW

SEQ ID NO: 7449 - protein, 124 aa, Zea mays
KPALTIPVMVMARMGNLLKAKILKALGVNYLDKSKVLTPADNPNKINKNNFRFPLVCGCRNLGKALPRLPKGPPIIRTKGEAGTGNFFKAVRNLRSVMGNFRPLRILDNNKVFAYAKRMAGPYN

SEQ ID NO: 7450 - protein, 387 aa, Oryza sativa (japonica cultivar-group)
MASAASVEEPAAAAAAAAETKRGPSGASFIREHLRSLAPYQPILPFEVLSARLGRKPEDIIKLDANENPYGPPPEVAKALGNLKFPYVYPDPESRQLRAALAEDSGLESEYILAGCGADELIDLIMRCVLEPGDKIVDCPPTFTMYEFDASVNGALVIKVPRLPDFSLDVAQIVKVVEQEKPKSIFLTSPNNPDGSIINDEDLLKILDLPILVVLDEAYIEFSSLQTRMSWVKKHDNLIVLRTFSKRAGLAGLRVGYGAFPLSIIEYLWRAKQPYNVSVAAEVSACAALQNPTYLEEVKNLLLQERDRLYDLLKEIPFLKPFPSHSNFILCEVTSGKDAKKIKEDLAKMGVMIRHYDKKELKGYIRISVGKPEHTDALMKGLKALQL

SEQ ID NO: 7451 - protein, 201 aa, Pseudomonas aeruginosa
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKDLGVFAGLANPLTVTRYHSLVVKRESLPECLEVTAWTQHADGSLDEIMGVRHKTLNVEGVQFHPESVLTEQGHELLANFLRQQGGVRGEGN

SEQ ID NO: 7452 - protein, 476 aa, Methanosarcina barkeri
MKMQINGKAVEACSGEFFDIINPATGELIDRVPKGTEDDAAIAVESASSAFNGWASTSPQQRARILYTAAGIVRQRKDELAVLLTREQGKPLAEAKNEIEGFAHVLEYYCGLASSFHGDFVPVPQNGYAFTVKKPLGVCTAIIPWNMPALIMAWKIGPAMISGNTLVLKPASNTPLTNLALASILSEAGLPPGVLNIVTGPGEVVGESLVKSPKVKKISFTGEVRTGKRIAELAAGGMKRVTLELGGSDPMLVCDDANLEAAVAGALRGRFYNCGQACTAVKRLFVFESVAERFIKKLEAGIRNLRVGNGLHENIDLGPLNNRRQWEYIKELVADAEEKDEGRIVAGGRVPEGSACSKGYFFEPTLIVDVDRKSRLLNEEVFGPVLPVVRVKDLDEAIEEANNTCYGLGASIWTKNLDRARIGCEQLNAGIIWLNQHLKVAPEVPFGGTRESGIGNENGPDALSEYLDLKTVMLKI

SEQ ID NO: 7453 - protein, 363 aa, Escherichia coli O157:H7
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDIELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 7454 - protein, 467 aa, Yersinia pestis CO92
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 7455 - protein, 362 aa, Lactobacillus gasseri
MKRYLILEDGSIYEGEGFGADCESSGEVVFTTGMTGYQEAITDQSYADQILVFTNPLIGNYGITLADYESLEPQIKGVVCHQVARHPDNWRMQTTLPKFLERLNIPGLQGIDTRELVKKLRIHGTLKGKITDSKENAVKIAQELKEKNITQGVISRVSTKNSYPVPGSKRNIVVVDFGIKHSILRELAERDCNCIVLPYTASADEILSLNPDGVLLSNGPGDPEEMVEAAKMVQEVEKHVPLFGICMGHQVFALANGAKTYKMKFGHRGFNHPVREIATGNIGFTSQNHGYAVDPASIDKENLMITHVEVNDGTVEGLRHKKYPAFSVQFHPDATPGPHDEDSLFDDFMSMIDQRKEEERHA

SEQ ID NO: 7456 - protein, 363 aa, Buchnera aphidicola (Diuraphis noxia)
MINSLIKLARINVQKLQPYQSARRIGGQHGDVWLNANESPVSVELSFKKKLLNRYPECQPIDLISAYADYVRLSTNQILVTRGADEGIELLIRAFCESGKDAIIYCPPTYDMYRVNAEIYNIKYKEVPTIKNTWQLDLLNIKLNLNSVKLIYICNPNNPTGSTCSKKDLFDLLEMTLNTSLVVVDEAYIEFLPKESMTLYLKKYPNLVILRTLSKAFALAGIRCGFVLAQKEIINILNKIISPYPISIPTASIALESLHKNYIKLMQNRVLDLNANRVWLINKLKKISSVKKIFQSNTNYILVQFFMSEEIFQMLWEKGIIVRNQDHKINLKQCLRITVGTHLECSRLIEEIKFFSKKYLKGV

SEQ ID NO: 7457 - protein, 457 aa, Sphacelaria tribuloides
DYNVKDTDVLALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMHWKERFLYCMEGVNRASAATGEVKGSYLNITAATIENMYERAEFAESVGTVICMIDLVIGYTAIQTMAIWARKAQLILHLHRAGNSTYARQKNHGINFRVICKWMRMCGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQFGATANRVALEAMVLARNEERDYVSEGREILRDAASTCGPLKAALDLWKDITFEYTSTDTPDFVEVATQSK

SEQ ID NO: 7458 - protein, 302 aa, Leptospira biflexa
RIGRLVLRSGIKDPNLEFVAINDLVTPDNLSYLFKYDSTHGRFDGDVSHTDNEIIIDGKKVKTFSERDPEKLPWKELGVDFVIESTGLFTDRVGAEKHIKAGAKKVVISAPAKDKDIPTFVMGVNHEKYDSAKDNVVSNASCTTNCLAPITKVVLDNFGIVEGLMTTIHAMTATQPTVDGPSKKDFRGGRGAAQNIIPASTGAAKAVGLCIPEVNGKLTGMSFRVPTPDVSVVDLTVRTEKPTSLAEIKKKMKEASEGSMKGILGYTEDMVVSNDFLGDIRSSIFDADACIELSPTFFKLVS

SEQ ID NO: 7459 - protein, 330 aa, Bacillus subtilis
  unsure (1)..(330): unsure at all Xaa locations
SNAXKELIKEHQKDINPALQLHDWVEYYRPFAANGQSANYIPALGKVNDSQLGICVLEPDGTXIHAGDWNVSFTXQXISKVISFIAACXSRGIPYVLDRVDVEPTGDAFNSIIRLEINKPGKPFNPXINAGALTIASILPGESAYEKLEFLYSVXETLIGKRPRIHEEVFRSEWETAHRNRALAYYLKETNFLEAEVEETLEVYLKQCAXESTTEDIALIGLILAHDGYHPIRHEQVIPKDVAKLAKALXLTCGXYNASGKYAAFVGVPAKSGVSGGIXALVPPSARREQPFQSGCGIGIYGPAIDEYGNSLTGGXLLKHXAQEWELSIF

SEQ ID NO: 7460 - protein, 429 aa, Ralstonia metallidurans
MSAIVDIIGREVLDSRGNPTVECDVLLESGVMGRAAVPSGASTGSREAIELRDGDKSRYLGKGVLKAVEHINTEISEAIMGLDASEQAFLDRTLIELDGTENKGRLGANAMLAVSMAVAKAAAEEAGLPLYRYFGGSGAMQMPVPMMNIVNGGAHANNSLDIQEFMIMPVSQTSFREALRCGAEVFHALKKILSDKGMSTAVGDEGGFAPNFSSNEECLNTVVQAIEKAGYKAGEDVLLALDCAASEFYHEAEGVYSLEGEGLKLTSTQFADYLANLCDKFPIVSIEDGMAEGDWEGWKTLTDKLGKRVQLVGDDLFVTNTKILKEGIEKGIGNSILIKINQIGTLTETFAAIEMAKRAGYTAVISHRSGETEDSTIADIAVGTNAGQIKTGSLSRSDRISKYNQLLRIEEDLGDIATYPGKSTFYNLR

SEQ ID NO: 7461 - protein, 297 aa, Zea mays
QSVPGLVILYGSIVKKKWAVNSAFMALYAFAAVWLCWVMWGYQMSFGQKLLPFWGKAGHTLGQGFLLSQAGLPATTHFFHGSGVVETGEITPLYPMASMVYFQCVFAAITLILLAGSLLGRMNFKAWMLFVPLWLTFSYTIGAFSIWGGGFLFHWGVIDYSGGYVIHLSSGVAGFTAAYWVGPRLTKDRERFPPNNVLLMLTGAGILWMGWAGFNGGDPYAANIDSSIAVVNTNICAATSLLVWTCLDVIFFKKPSVIGAVQGMITGLVCITPGAGTVHIHDSVYNHYSTLLLPVPA

SEQ ID NO: 7462 - protein, 374 aa, Zea mays
MALSKEQKLTIPDQQHTTSSEQQVALDAELQLWNHTFGYVKSMALKAALDLGIPDAIHQHGGSATIPQIVTRITLHPSKTPCLRRLMRVLTLTGVFGTQEPHDDGGGCDDELVYTLTPASRLLVGPSGQNVSPLLNVMLCPILVSSFLDLRGWFQHEMPDPSPFKVTHGRDIWELAAHDAGFRRLFDAGMVADSGFIMNVVVRECGAVFQGISSLVDVGGGFGGATQAIAKAFPHLECSVLDLPNVVAGAPADTAVKYVAGDMFESVSSADAVFLKWIIHDWGDADCVKILKNCKKAIPAQGGKVIILDIVVGAGSSCDRKNVETQCLFDLYIMTINGVQRDEREWKKIIFEAGFTSYKIIPVLGTRSIIEVCP

SEQ ID NO: 7463 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 7464 - protein, 251 aa, Brassica oleracea
MGRGRVEMKRIENKINRQVTFSKRRAGLLKKAHEISILCDAEVSLIVFSHKGKLFEYSSESCMEKVLEHYERYSYAEKQLKVPDSHVNAQTNWSVEYSRLKAKIELLERNQRHYLGEDLESISIKELQNLEQQLDTSLKHIRSRKNQLMHESLNHLQRKEKEILEENSMLAKQIRERESILRTHQNQSEQQNRSHHVAPQPQPQLNPYMASSPFLNMGGMYQGEYPTAVRRNRLDLTLEPIYNCNLGYFAA

SEQ ID NO: 7465 - protein, 325 aa, Arabidopsis thaliana
MEESKRNLLDEEAKASLDIWRYVFGFADIAAAKCAIDLKIPEAIENHPSSQPVTLSELSSAVSASPSHLRRIMRFLVHQGLFKEVPTKDGLATGYTNTPLSRRMMITKLHGKDLWAFAQDNLCHSQLINEAMACDARRVVPRVAGACQGLFDGVATVVDVGGGTGETMGILVKEFPWIKGFNFDLPHVIEVAQVLDGVENVEGDMFDSIPASDAVIIKWVLHDWGDKDCIKILKNCKEAVLPNIGKVLIVECVIGEKKNTMIAEERDDKLEHVRLQLDMVMMVHTSTGKERTLKEWDFVLTEAGFARYEVRDFDDVQSLIIAYRS

SEQ ID NO: 7466 - protein, 343 aa, Oryza sativa (japonica cultivar-group); identical to SEQ ID NO: 3612

SEQ ID NO: 7467 - protein, 753 aa, Neurospora crassa
MARKQATEAPAVSNGSPKKRSSADSDNHNVKRPRLQESTDKARWRLSSEGGRHTWHYLEDDEAAKEWPQSYADKYFLGMPLVKHPAELPELPKATNPLDAVRNGLTFFEKLQLPEGHWGCEYGGPMFLLPGVVIARYVTKNPVPWYYATEIKNYLFARANPVDGGWGLHIEGESTMLGTTLNYTTLRLVGVEADHPVMVKARATMHKMGGAIYAPHWAKFWLTVLGIMKWDIVNPVPPELWLLPDWVPIAPWRWWIHMRQVFLPMSYLWSKKWQAEETDLIRELRNELFVEDWNKIDWAGNRNTIHPNDNYHPKTAFLNTVNWLLVNIWNPVFRTKYLVEKAEAWASELIDMEDENTDYSDLAPVNAAMNTVCCYVRDGPGAYSVRRHVERLDEVLWVNAEGMLCNGTNGVQCWDTAFAIQAIMDAGLTEDPRWRPMLIKSLEFLEDQQIRENVKDQDKCYRHPRKGAWAFSNKDQGYAVSDCVSEALKSVIILQKTPGFPTLIDDQRIFDAVDTMLTYQNPSGACSSYETPRAGQWMEVLNAAEVFGNIMVEYEYPECTTAVLTTLSLFKKHWPNHRTAEIDNFITRAVKWIKSNQKPHGGWYGNWGICFTYATMFALESLASVGETYENSRYAKKGCDFLVAKQREDGGWSESYKACETGEYVEHPTGSQVVMTAWALVGLIKAKYPNNDPIKKGIKLIMDRQQPNGEWRQEAIEGVFNKSCMISYPNYKFSFPLKALGLFATRYPDEKVV

SEQ ID NO: 7468 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGIFLLFAGLILGMGSFVYFLLPETKQVPIEEVYLLWRQHWLWKKYVEDVDE

SEQ ID NO: 7469 - protein, 790 aa, Streptomyces avermitilis MA-4680
MTKTTPSRGRRRAPSRMERAAGKAAALQKPRVILALLLLLGLTSVMLLDGYLRGEVFSDQRVRDSAAYDKVPKKILEAGPIFTSSNGTVDPKSVPKKTIVLTFDDGPNPTYTEKVLKILQDNDVPGTFFLVGSMVTRYPDAVKDMVDQGNEVGIHTFTHVDLSYQSTARVERELNQTQLALAGAAGITTTLFRAPYSAEADAIDNYSWPVYQRMAKLGYTSVFIDTDSDDWKQPGVASIIKTATPKKNNGASVLFHDAGGDRDQTLVALPKYIKKMKAKGYTFTTVSGALAKDRASTAAGRAGAGTGTGQQPIDQTANGGAANGGTANGGTANGGTANGRQPGAAAGTGTATGATATSIEQAAHRKATGATLYEGKALVAAVALAEWSMPALASGLVVVGVAVMGRFAMMLVLARTHYRQRNKRRFSWGPEITRPVSVIVPAYNEKECIENTINSLAQSTHPIEIIVVDDGSTDGTADIVEAMRIPNVRVLRQENAGKPAALNNGVRNASYDIVVMMDGDTVFEADTVRRLVQPFADDEVGAVAGNAKVGNRDTVIGAWQHIEYVMGFNLDRRMYDLLRCMPTIPGAIGAFRREAVLEVGGMSEDTLAEDTDITIAMHRGGWRVVYEEHARAWTEAPGSLKQLWSQRYRWSYGTMQALWKHRKSLTDRGPSGRFGRVGMPLVVIFQIVTPVFAPLIDVFTVYSMIFVDFWASLLAWLAVLVVQLVCAAYAFRLDREKYRYLLMMPLQQLAYRQMMYLVLIHSCITALTGGRLRWQKLKRTGEVGTPAGVS

SEQ ID NO: 7470 - protein, 759 aa, Dechloromonas sp. RCB
MDSRQLREAALYYHREPKPGKIAVTPIKQLTNQYDLSMAYSPGVAFACEEIVADPREASTLTSRANLVGVITNGTAVLGLGAIGPLAAKPVMEGKGVLFKKFANIDVFDIEIEERDPDKLIDTIASLEPTFGGINLEDIKAPECFYIEKKLRERMKIPVFHDDQHGTAIVVGAAILNGLHLIGKDLAKVKIVTSGAGAAALACLDLLVMLGAPPSNIWVTDIKGLVYEGRVEEMDEIKARYAKVTDARTLGEVIADADVFLGLSAGGVLKPEMVAKMASNPLIMALANPTPEITPELVKSVRNDAIICTGRSDYPNQVNNVLCFPFIFRGALDVGATTITEEMKMAAVKAIAELARAEQSEVAARAYGEKVASFGPEYLIPNPFDPRLIVKIAPAVAKAGMDSGVATRPIKDWDAYIQGLNEFVYHSGMIMKPVFSQAKMAPKRIVFAEGEDERVLRAVQVVRDEGIAWPILIGRHAEINRRIEVAGLRIREGEDFEVVHSDNSAFFDEHYEEFWQTYHGLMERKGVSPDYARREVRRRNTLYGALMVRLGYADGLICGTFGRHETHREYVQSVIGTRADHDRYYAMNLLMLPERTVFIGDTYVNYDPTAEQLADMTLLAAEEIRNFGIVPKVALLSHSTFGTEDTPTSVKMRDVLAQLKQRAPDLEVEGEMHGDAALDEQIRKAAFPNSRLKGQANLLVMPTLDAANISFNLLKVAAGDNLTIGPILLGAAKPVNILTPTATVRRIVNMTALTVVDAV

SEQ ID NO: 7471 - protein, 482 aa, Glycine max
  unsure (1)..(482): unsure at all Xaa locations
IPVDAPLGTAALAQVPSEHVKSTSTVGLPRTVEDLATIVSIKARXQIFDSRXGNPTVEVDLTCSDGTXARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAAFXNSTRRDKTYDLNFKEDNNDGSQKISGDALKDLYKSFVTEYPIVSIEDPFDQDDWXHYAKLTAEVGTNVQIVGDDLLVTNPXRVQKAIDTKACNALLLKVNQXIGSVTESIEAVRMSKXAGWGVMASHRSGETEDTFIADLSVGLATGQIKTGAPCRSERLAKYNQLLRIEEELGAEAVYAGANFRXPVEPY

SEQ ID NO: 7472 - protein, 520 aa, Perilla frutescens
MAAVASSSPMGFSKICGLNSVSELSGQCKPTVGFSKSELFGGAVCVKSISKNGGRGNARTRLPSARVVSPKAVSDTSSSLTCLEPDANFSELAFFLEWSGTRLYLLRKKRAKPAVPIGANYRLNDIPVSNCLNSNVSKIYVLTQFNSAFLNRHLSRAYASNMGGYKNEGFVEVFAAQQSPENPNWFQGTADAVRQYLWLFEEHDVLEYLVLAGDHLYRMDYEKFVQSHRETDADITVAALPMDEKRATAFGLMKIDDEGRIIEFSEKPKGEALKAMRVDTTILGLDDERAKEMPYIASMGIYVFSKNAMLNLLRDKFPGANDFGSEVIPGATSVGLRVQAYLYDGYWEDIGTIEAFYNANLGITKKPVPDFSFYDRSAPINTQPRYLPPSKMLNADVTDSVIGEGCVIKNCKIHHSVIGLRSCISEGAIIEDTLLMGADYYETDSDRRILAAKGGIPIGIGKNSHIKRAIIDKNVRIGENVKIINSDNVQEAARETDGYFIKSGIVTVIKDALIPSSTII

SEQ ID NO: 7473 - protein, 168 aa, Saccharomyces cerevisiae
MNKWSRLYVITVRRTFPGRRNIVLTQYWNKSKKMSDESNDVKWNDALTPLQLMVLRDKATERPNTGAYLHTNESGVYHCANCDRPLYSSKAKFDARCGWPAFYEEVSPGAITYHRDNSLMPARVEICCARCGGHLGHVFEGEGWKQLLNLPKDTRHCVNSASLNLKKD

SEQ ID NO: 7474 - protein, 181 aa, Rhodobacter sphaeroides
MKIAIVTASDRASRGDYEDLSGPAIADWLATAMTSPYEIVRRIVPDGVETVRTALIELCDAEGAALVFTTGGTGPSPRDLTPEAMVGVIEKELPGFGELLRSIGLQQTPTAILSRQTAGVRGRSLIVNLPGQPAAIALSLQGVFGAIPKCLDLIGAGRMTVSDRWGAEGRAAPTLPDYLRS

SEQ ID NO: 7475 - protein, 473 aa, Griffithsia pacifica
YESGVIPYAKMGYWDPDYAIKDTDILALFRVTPQPGVDPVEASAAVAGESSTATWTVVWTDLLTACDLYRAKAYKVEAVPNTSDQYFAYIAYDIDLFEEGSIANLTASIIGNVFGFKAVKALRLEDMRIPVAYLKTFQGPATGVIVERERMDTFGRPFLGATVKPKLGLSGKNYGRVVYEGLKGGLDFLKDDENINSQPFMRWKERFLYSMEAVNRSIAATGEVKGHYMNVTAATMEEMYERAEFAKQLGTVIIMIDLVIGYTAIQTMGVWARRNDMILHLHRAGNSTYSRQKIHGMNFRVICKWMRMAGVDHIHAGTVVGKLEGDPLMIKGFYDTLLLSHLDINLPQGIFFQQDWASLRKVTPVASGGIHCGQMHQLVDYLGEDVVLQFGGGTIGHPDGIQAGATANRVALESIIIARNEGRDYVAEGPQILRDAAKTCGPLQTALDLWKDITFNYTSTDTADFVETPTANV

SEQ ID NO: 7476 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGAVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAAR

SEQ ID NO: 7477 - protein, 363 aa, Escherichia coli K12
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAACAIERAINRALEEGIRTGDLARGAAAVSTDEMGDIIARYVAEGV

SEQ ID NO: 7478 - protein, 205 aa, Haemophilus influenzae
MEQYGFYFDSERCTGCKTCELACKDYKDLGTEVNFRRIYEYTGGQWNQQADGCWHQNIFGYYMSISCNHCADPACTKVCPTGAMHKNADGFVIVNEEICIGCRYCHMACPYDAPQYDAQKGHMTKCDGCYSRVKSGQKPICVDACPLRALDFAPIDELRTKYGTQASIAPLPPTDITQPNLVVKPNKYARLSGDTSGFLGNPREV

SEQ ID NO: 7479 - protein, 309 aa, Chloroflexus aurantiacus
MTEYANLGFYQPCGVSVRRALGARDDQLTVRPDLTVVIEEFANLPGSHLTPQQIFALVQRIQQVRDGYDGILVATGSDTLEEAAFLIDLLLPAGSPVVITSLPRLSTGGVSETNGLQAAMAVAATPAVAGAGALVVVDNTIYAAATIQMQFSQGPGMVTAPLGALGRVEGDQVSLRLQPVGRQQIAAPRLVEPVDLIRIGVGADDRQLRHSIADNVAGIVIETLGSGRVPPWWLPAIGEAVQRRIPVVVVSRAGAGGLGDEFGYVGAYHDLRKLGVIFAPDLSGIKARLKLMAALAVARSPAELRALFR

SEQ ID NO: 7480 - protein, 447 aa, Pisum sativum
AALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEESGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 7481 - protein, 404 aa, Triticum aestivum
MAFCSPHTTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 7482 - protein, 180 aa, Lycopersicon esculentum
MASSIVSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 7483 - protein, 584 aa, Oryza sativa
  unsure (1)..(584): unsure at all Xaa locations
METHIGSVDGAAAAADNGAVGCPASAVGCPMTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCAQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSANPLVPEXEPLAIGMALGEKDCLCFIEVIAHKDDTSKELLEWGSRVSAANSXTKSSVETFSTCCKLGXHNNVNTLPFSYVPXVSIPSGFCSSSFGSSVSTCEHLFLQSNATRVMRGFQLAKKXDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 7484 - protein, 188 aa, Streptococcus pyogenes MGAS8232
MILLIDNYDSFTYNLSQYLSEFDETIVLYNQDPNLYDMAKKADALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 7485 - protein, 164 aa, Glycine max
FGSSKVSDVELDQISLLPNAEYLLTSFLSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 7486 - protein, 388 aa, Phormidium lapideum
MKLAARVESVSPSMTLIIDAKAKAMKAEGIDVCSFSAGEPDFNTPKHIVEAAKAALEQGKTRYGPAAGEPRLREAIAQKLQRDNGLCYGADNILVTNGGKQSIFNLMLAMIEPGDEVIIPAPFWVSYPEMVKLAEGTPVILPTTVETQFKVSPEQIRQAITPKTKLLVFNTPSNPTGMVYTPDEVRAIAQVAVEAGLWVLSDEIYEKILYDDAQHLSIGAASPEAYERSVVCSGFAKTYAMTGWRVGFLAGPVPLVKAATKIQGHSTSNVCTFAQYGAIAAYENSQDCVQEMLAAFAERRRYMLDALNAMPGLECPKPDGAFYMFPSIAKTGRSSLDFCSELLDQHQVATVPGAAFGADDCIRLSYATDLDTIKRGMERLEKFLHGIL

SEQ ID NO: 7487 - protein, 458 aa, Oryza sativa (japonica cultivar-group); identical to SEQ ID NO: 2754

SEQ ID NO: 7488 - protein, 860 aa, Aspergillus aculeatus
MKLSWLEAAALTAASVVSADELAFSPPFYPSPWANGQGEWAEAYQRAVAIVSQMTLDEKVNLTTGTGWELEKCVGQTGGVPRLNIGGMCLQDSPLGIRDSDYNSAFPAGVNVAATWDKNLAYLRGQAMGQEFSDKGIDVQLGPAAGPLGRSPDGGRNWEGFSPDPALTGVLFAETIKGIQDAGVVATAKHYILNEQEHFRQVAEAAGYGFNISDTISSNVDDKTIHEMYLWPFADAVRAGVGAIMCSYNQINNSYGCQNSYTLNKLLKAELGFQGFVMSDWGAHHSGVGSALAGLDMSMPGDITFDSATSFWGTNLTIAVLNGTVPQWRVDDMAVRIMAAYYKVGRDRLYQPPNFSSWTRDEYGFKYFYPQEGPYEKVNHFVNVQRNHSEVIRKLGADSTVLLKNNNALPLTGKERKVAILGEDAGSNSYGANGCSDRGCDNGTLAMAWGSGTAEFPYLVTPEQAIQAEVLKHKGSVYAITDNWALSQVETLAKQASVSLVFVNSDAGEGYISVDGNEGDRNNLTLWKNGDNLIKAAANNCNNTIVVIHSVGPVLVDEWYDHPNVTAILWAGLPGQESGNSLADVLYGRVNPGAKSPFTWGKTREAYGDYLVRELNNGNGAPQDDFSEGVFIDYRGFDKRNETPIYEFGHGLSYTTFNYSGLHIQVLNASSNAQVATETGAAPTFGQVGNASDYVYPEGLTRISKFIYPWLNSTDLKASSGDPYYGVDTAEHVPEGATDGSPQPVLPAGGGSGGNPRLYDELIRVSVTVKNTGRVAGDAVPQLYVSLGGPNEPKVVLRKFDRLTLKPSEETVWTTTLTRRDLSNWDVAAQDWVITSYPKKVHVGSSSRQLPLHAALPKVQ

SEQ ID NO: 7489 - protein, 342 aa, Magnetospirillum magnetotacticum
  unsure (1)..(342): unsure at all Xaa locations
MVVVFAVINLWGVRQFGELEFWFAFVKVAAIVGFLVVGVLLVLGXAAPGRSXXSARXEPXLXGPRGGXSXPEGWGGIAAGLLVVVFAFGGIEIVTIAAAEAREPRTAVARATRSIVWRILVFYLGSVAIMVLVLPWDSPLLAESPFVAVLDLAGLPGAARVMEVVVVVALLSAFNANVYGTSRMAYSLAGRGDGPRALRRVSRRDVPWVSVLVSVFFALVAVGLNWLLPEALLGILLNAVGAALLVVWVLVAVSQLRLRRRIEAQARASGEPMTLRMWGFPWLTWAVLVGLAALAVLMLTDAAARAQLVSTAGLVVVILAVYLVTRRGRARRGAAAGARADG

SEQ ID NO: 7490 - protein, 315 aa, Glycine max
FVDNEDLQVQWREAKRSNKVKVAAFIREKTGYSVSPDAMFDIQVKRIHEYKRQLLNIFGIVYRYKKMKEMSAAERIANFVPRVCIFGGKAFATYVQAKRIVKFITDVGATVNHDPEIGDLLKVVFVPDYNVSVAEMLIPASELSQHISTAVMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPSYIECQEKVDEAYRNQTKWTRMSILNTAGSYKFSSDRTIHEYAREIWNIEPVQLP

SEQ ID NO: 7491 - protein, 416 aa, Oryza sativa
  unsure (1)..(416): unsure at all Xaa locations
FACQDAGEGDKLAAAVLTLEELRLGETSEEFTGTSSLSTTNDDETSSTTTESMFYISPNGRFRRKIRSWNRGMLLGSGSFGTVFEGISDEGVFFAVKEVCLCDQGSNAQQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFNVLKSCKGTVYWMAPEVVNPKTTYGPEADIWSLGCTVLEMLTRQLPYPGLEWTQALYRIGKGEPPAIPNWLSRDARDFISQCVKPNPQDRPSAAKLLEHPFVNRSMRSIRSMRTSSRSNSSNIGGMILVLLIMWSWPGRTIRYREAILSTAXQSSTPTIAFHLLILSHSLLRGDMSWFSQRLIFSPENRLNVHSSA

SEQ ID NO: 7492 - protein, 363 aa, Oryza sativa (japonica cultivar-group)
MGSLAAEKTVTGWAARDASGHLTPYNYTLRKTGPEDVVVKVLYCGICHTDIHQAKNHLGASKYPMVPGHEVVGEVVEVGPEVTKYSAGDVVGVGVIVGCCRECHPCKANVEQYCNKRIWSYNDVYTDGRPTQGGFASAMVVDQKFVVKIPAGLAPEQAAPLLCAGLTVYSPLKHFGLMSPGLRGGVLGLGGVGHMGVKVAKSMGHHVTVISSSARKRGEAMDDLGADAYLVSSDAAAMAAAGDSLDYIIDTVPVHHPLEPYLALLKLDGKLILMGVINQPLSFISPMVMLGRKAITGSFIGSMAETEEVLNFCVDKGLTSQIEVVKMDYVNQALERLERNDVRYRFVVDVAGSNIDDADAPPA

SEQ ID NO: 7493 - protein, 427 aa, Rickettsia sibirica
MSQKLGFWAVFALVTGSQIGTSVFILPLSLAPFGIYSIWGWVLSLFGAMSIALVFSTLCAKFPKTGGPHVYVRENFGDKIAFFTGWTYWVISFVSTSIVVISAIGYLTPFFKSQAILDLILQIILLGAIMVLNLKGPEVAGKAEFYLTLLKFVPLLIVGLCALSHFNIDNITIAEEVENLSIPSIMGRVVLLTFWGFIGIECATTTAGAVKDPAKTIPRAIIVGTFCVAVLYIINSIGIMGLIPASELVSAKAPYADAASLLFGGKWSSVITVIASIICIGTLNAWVLTSGQIALGLAEDGLLPKFFAKKNSNNAPTHGIIVSCLGIVPLLVFTANDNFAKQITQIIDFSAITFLFVYLICSLAFLKVIFSSKENFSYYYLLIAIISIIFCAWVIYETPVKTLIIASAFTIFGIPLYYGWYKCHARL

SEQ ID NO: 7494 - protein, 124 aa, Triticum aestivum
MICAVSSLRAMGGGNDGHGYPPGGQGGYPPAGYPSHQQGYPPLPGAYPPAPGVYPPVPGAYPTAPGHGYPQQGYPPQHGYPPQQHGYPPQQHGYPPAGYPGSSGIYHSLVFQSLILIRICAKPS

SEQ ID NO: 7495 - protein, 150 aa, Mycoplasma pirum
MKKRIIIGNWKTNKTQKEVKEFFKILNASLKNKNICCTFGVAPVAIHLELAKSLAPKQMIIAAQDANYISSGAFTGTISWSQLKDIKIKYVIVGHSERRMYYNETDDIVNKKVKNLLENKMIPILCIGGNIEEFNNKKTYQVCATQLKKA

SEQ ID NO: 7496 - protein, 666 aa, Leuconostoc mesenteroides subsp. mesenteroides ATCC 8293
MSTEFNLSFVQGLTVREKAELVTGKDFWFTAENIENDIPKIMVTDGPSGLRKQASSADALGLNQSVEAIAFPSSALMASSFNVDMLYQLGQNLGTASRAENVSVLLGPGINIKRSPLAGRNFEYFSEDPYLTGELGSAYVKGVQSQGVGVSVKHFAANNREDQRFTSSSNVDERALREIYLLAFEKIVKEAHPATLMCSYNAINGVLNSQNYRLLTEILRNEWGYTGVVMSDWGAVADNIASLKAGLDLEMPGNGAYSIDRIVSAVQNGQLEESKLDISVLRVLALVEKFRVSEDDSTDYDKNNQHEFARKAAEDSIALLKNDDDVLPIKQTEKIALIGELAQNPRYQGGGSSHVNAYKVVTPHEVASNSDYNVTYTAGYSLSEEKGNLDLEQQAESIAELSDKIIFFAGVPEQDESEGFDKKTIDLPENQVNLIQKLSAINPNIIVVLQNGSAVATPWRNKVKAIVETYLAGEAVGEATWNILTGQTNPSGKLAETFPEKIEDTPAYGTFNASVDEENYHEGIFVGYRHYDLKRKEVAFPFGHGLSYTDFKYDDLEIVANTKKHVTGKIKITNVGSIYGKETAQIYIQNLESRVEKPRQELKAFVKVGLNPGESKTVEFFLDRRSFAWYNVKKSIWQVDQGDYNLKIGSSSRDIRLEKTVSLEMG

SEQ ID NO: 7497 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPGLTDMVIFRENSEDIYAGIEWEADSADAEKVIKFLREKMGVKKIRFPEHCGIGIKPCSKEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLV

SEQ ID NO: 7498 - protein, 528 aa, Oryza sativa
  unsure (1)..(528): unsure at all Xaa locations
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFDHLTGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTPVIPRVRAIGRDAARWEEAEVFDPDRFEAKRVEFNGGHFELLPFGSGRRICPGIAMGAAXNVEFTLANLLHCFDWALPVGMAPEELSMEESGGLVLHRKAPLVLVPTRYIQL

SEQ ID NO: 7499 - protein, 516 aa, Zea mays
MFVRVCVIINRSIMLFTLFISVCSCICGRAKINHGRLGFIKPMYPTVCNNAMENEPKRMLPFQKKKKEKDKSAITSKKNETKCDTWCELQNPANHRVFERKLRPKPSGGGHRGRPGCHQSNTQTTMGHQAQHGTDDTEELLAAHRQLWCHALGYVKSMALKCALDLRIPDTIDRCGGSATLGELLAASEIPASNHDYLRRVMRTLTAMRIFAVSHDDPAKADDAAAISYQLTPASRLLVSSSSSSVDAAAAGAGASKENTTTPSILPNIAHLVRPNTISLLFSMGEWMKDESAASVSLYETVHRQGMWACVEDDAANRASFYESMDADTRLVMQAVVRRCPHVFDGIKSLVDVGGGRGTAAAAVVAAFPHIQRCTVMDLPHVVAEAPAGTAGLSFHGGDMFEHIPSADALMLKWILHDWDEDKCIKIMERCKEAIGGKEAGGKVIIIDTVLGSRADDDDDDKTCRETYVLDLHILSFVNGAEREEHEWRRIFLAAGFRDYKITHTRGIPSIIEVFP

SEQ ID NO: 7500 - protein, 352 aa, Zea mays
  unsure (1)..(352): unsure at all Xaa locations
TSLSLLVYLCSGLLPNGNFELGPAKSDLNGTRVMNQNSVPNWEIFGFVEYIGSGQKQDDMILAVPEGACAVRLGNDATIRQKLEVIRKTTYSITFCAARTCAQAERLNVSVAAESGVLPIQTVYTSSGWDSYAYAFRARHSTAWFSIHNPGHEDNPACGPLIDFIAIKALNPPPLAQXTVCNMLRNGDFEEGPFIFPDTAWGVLVPPMSEDDVSPLPGWMVMSDTKVVKYVDAAHHAVPRGARAVELVAGREAALVQDVRTVPGRRYRLSLSVGDAANGCEGPMAVEAYAARATLRTTYESLGKGGSRRAAVEFEATANLTRVVLQSYNHHMKPDGTLCGPVVDDVSLVCLR

SEQ ID NO: 7501 - protein, 764 aa, Glycine max
  unsure (1)..(764): unsure at all Xaa locations
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPAKMWCYCRLVYMPMSYLYGKRFVGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLXARVPDYLWVSEDGMTMQSFGSQEWDAXGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFITNAVRFLEDTQTADGSWYGNWGVCFTYGSWFALGGLAAAGKTYTNCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 7502 - protein, 299 aa, Zea mays
  unsure (1)..(299): unsure at all Xaa locations
MSFHYHDHGLSMDAAAARGRRXPSSPNPSGFSPGIGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLMLTEGERSLVERVRKELKNELKQGYKEKLVDIREEIMRKRRAGKLPGDTASVLKAWWQAHSKWPYPTEDDKARLVQETGLQLKQINNWFINQRKRNWHSNPTSSAEKTKKKR

SEQ ID NO: 7503 - protein, 164 aa, Sesamum indicum
DEIDFEFLGNVSGEPYTVHTNVYAGGKGDKEQQFHLWFDPTAAFHTYSIVWHPQRIIFLVDNSPIRVFNNHKSIGIPFPTSQPMRVHCSLWNADDWATQGGRVKTDWTKAPFVAYYRNFKIDGCPVGTSGGSCGFQSQTQELDAKGRNRMRWVQQKHMIYNYCT

SEQ ID NO: 7504 - protein, 625 aa, Schizosaccharomyces pombe
MGFSKIALFSLFALFGLPTSLAKSSEEWRDRIIYQVITDRFAVDSDNTPDCSFDDSSYCGGTWSGIRSKLDYIQGMGFNAIWISPVEKNLEGSYGSDGEAYHGYWNTDFTQLNEHFGSEDDLIDLITDMHNRDMWIMFDALANSMAIPGPTDNISYSNLVPFNDSSYFHPYCWIDYGSNNNTDIEDCWTGDDNVILADLDIESTNVADYLHEHIHDMVERYQIDGIRIDAVKQMNPEFFPNYTSAAGVFAIGEMFSYDPNVSCSVRNYLDSITSYPIRQGIEFAFNYTGAAFEYLQEIDTQFQQACEGQDMSVIGNFLENHDLPRYTSITNDTSQDIGAIVFLLLHTGIPIIYYGEEQRLPGGSDTPENRAALWNYGYDTDANYYQTIRTAIALRKQAISDSDSWTTDSHSYLDYDLRHAVVRKGDVLGVYTNYESSSDNVTYDVSSNFDDGTVLREVLSNTTTTVGSSGALHVTVVSGLPQVYYPEASLTSFGNFLGTATSYSSASASYPSTSMSASLSSVHTSSATSSSKSSSSSSSRSGSSSSSSSRSGSTSSSGSSHTITSTSQSVHTSGSSTSTSSVAVTSTAYSSSSSSSSSSSIESSANAVRVSILGVAAFIAIVLFI

SEQ ID NO: 7505 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 7506 - protein, 233 aa, Triticum aestivum
  unsure (1)..(233): unsure at all Xaa locations
MGRSPCCEKAHTNKGAWTREEDERLVAHVRAHGEGCWRSLPSAAGLLRCGKSCRLRWINYLRPDLKRGNFSRDEDELIVKLHSLLGNKWSLIAARLPGRTDNEIKNYWNTHIRRKLLGRGIDPVTHRPLTDAATVSFVHPAEATKQQATEERKPPRCPDLNLDLCISLPFQQEEERPPARACAKPVKMEQLQQGGICFRCSILRVRGAXTECSCGSNFLGLRAGMLDFRGLEM

SEQ ID NO: 7507 - protein, 385 aa, Glycine max
  unsure (1)..(385): unsure at all Xaa locations
MGNNRFRLSDMMPNAWFYKLKDMSKSRKRNGPHVMKNKVASPTTSQRSQPRYSHYFSIEPNIAGKLYNSPIFYTKHSDNTFTDSPRRSSKRRAGRKTIYKPSPTVVSSPVIESFGCHSTNNWIKPNQLQSPDYYALLHRDFFFXSNLNDEYVSSESECDKFTIPDLLNGVASECSCRVSSSTNDIIIDMKNEPFNGNSENLDGFDTISQLGLAPILTKPVKFDDKVIETTELRRSAKFDELKSHQSLSVIVSKEECSRTKRERKTSPVARVSSANSPGIKLRVNSPKLASKKVQAYARRSVSSRACKASMNSGFPEGFAVVKSSLDPQRDFRESMVEMIVENNIHASKDLENLLACYLSLNSREYHDLIVKAFEQIWYDMAQLRM

SEQ ID NO: 7508 - protein, 416 aa, SYNECHOCOCCUS SP. WH 8102
MSGSAEPYGREGLPLEEARRRVLAAIQPITASNTVPLQQALGRVSAAAVLASEAVPGFRASIMDGYALGQSHQPKPGETWLLKGRSAAGQPFNGTLANGDAIRILTGAPLPDGAGWVLPQELISIDGSSLQLAKKASDRPWIRPEDEECRPGDLLLSAGQRLGAADLARLAGCGIADLTVAQQPRIGLLISGDELVPPGTARQPGAIWESNGTLLETMLRALRQSVTERRVVADQPDALRQALLDLAHDCDVVVSTGGVSAGDTDWIRPLVAELGAVDFWKLFLRPGRPFAFGSIGEGVPFFGLPGNPVAAAVTALQLLWPALQVLEGQSEPELFPRVMVELADPLSRRPGRPELARARLDTNAAGKLLARVDGSQASSRIGSLQQADLLLELPAEAGPLERGTRLWAQVIRQRIF

SEQ ID NO: 7509 - protein, 341 aa, Arabidopsis thaliana
MFRSMIVRSASPVKQGLLRRGFASESVPDRKVVILGAAGGIGQPLSLLMKLNPLVSSLSLYDIANTPGVAADVGHINTRSQVSGYMGDDDLGKALEGADLVIIPAGVPRKPGMTRDDLFNINAGIVKNLSIAIAKYCPQALVNMISNPVNSTVPIAAEIFKKAGTYDEKKLFGVTTLDVVRARTFYAGKSDVNVAEVNVPVVGGHAGITILPLFSQASPQANLSDDLIRALTKRTQDGGTEVVEAKAGKGSATLSMAYAGALFADACLKGLNGVPNVVECSFVQSTITELPFFASKVRLGKNGVEEVLDLGPLSDFEKEGLEALKAELKSSIEKGIKFANQ

SEQ ID NO: 7510 - protein, 411 aa, Glycine max
MALRLNPIPTQTFSLPQMASLRSPRFRMASTLRSGSKEVENIKKPFTPPREVHVQVTHSMPPQKIEIFQSLEDWAEENILAHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFESDPDGTVMAFADMMRKKIAMPAHLMYDGRDDNLFDNYSSVAQRIGVYTAKDYADILEFLVGRWKVEQLTGLSGEGRKAQEYICGLPPRIRRLEERAQARVKESSTLKFSWIHDRESTTLNAPREEHGEIFRQYRSEKC

SEQ ID NO: 7511 - protein, 461 aa, Escherichia coli K12
MADNKPELQRGLEARHIELIALGGTIGVGLFMGAASTLKWAGPSVLLAYIIAGLFVFFIMRSMGEMLSLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 7512 - protein, 192 aa, Buchnera aphidicola
MNDILLLDNIDSFTYNLVDQLRINNYNVVIYRNTISIKIIIKKISKMYRPVLILSPGPGNPENAGCMPELLDKMRGKIPIIGICLGHQAIVKMYGGHIKYAGEILHGKASLIQHDGKAMFCGIPNPFFAARYHSLICNKVPNILTVNAYYNDMVMAVRNDDEKICGFQFHPESILTIHGTELLKNTMIWISK

SEQ ID NO: 7513 - protein, 247 aa, Pisum sativum
MGRGRVELKRVENKINRQVTFAKRRNGLLKKAYELSVLCDAEVALIVFSNRGKLYEFCSTSSMLKTLERYQKCNYGAPEGNVTSKEALVLELSSQQEYLKLKARYESLQRSQRNLMGEDLGPLSSKDLETLERQLDSSLKQIRSTRTQFMLDQLGDLQRKEHLLCEANRALRQRMEGYQINSLQLNLSAEDMGYGRHHQGHTHGDELFQVQPIECEPTLQIGYHQGDPGSVVTAGPSMNNYMGGWLP

SEQ ID NO: 7514 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKSRKRQLSNDSTDPIESKTVKKIKCHQWKNLDSMEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 7515 - protein, 166 aa, Glycine max
  unsure (1)..(166): unsure at all Xaa locations
MEVMGGSSFGICTAACVRDRGGVSAQDKAVXAAGWGGADESLRGGGSQIGLASRIELSMSNKSAEESSEDSSWWIGEISDNHEEDEDDAVSSQGEGXALASFSSSLEDSLPTKRGLSNHYVGKPKSXGNLMESSNIKAKDLEKCENPLIKKRTLLIANKLRRRGRS

SEQ ID NO: 7516 - protein, 2371 aa, Schizosaccharomyces pombe
MRNKNILVLNLILSIPRLVFTAKYDERESLWNLNQNQSATDPLDYWGKWENHQYHPSPDDWQVPFYTVILDKWKDGDPRNNEANNTIYEYDIYETGFRNGGDIIGLKDSLDYLEIMGIKVRRVMLLCSLTNKVIYIAGTPFLNQPWGADQYSPLDYTILDHHSGTIAQWRDTIEEIHRRGFYLVLDLTISTLGDLIGFRKYLNSTTPFSLFEHEAVWKSNVIYPDWNFTNKYDPKCELPRFWGEDGAPVVIDYVGCYDSDFDQYGDTEAFGTHPDWERQLSKFASVQDRLREWRPSVSEKLKHFACMIIAMLDVDGFRIDKATQITVDFLASWAHSVRGCAATFNKKNFFIPGEVTGSSSYGSIYYGRGRQPDQRPPSILTSLNSSSLKENYFLREPKANALDASAFHYSLYRAMTRFLQMDGDLQVGHDLPVDFTDLWNAMAVNEDFYNPNTHKVDPRHMLGITNHDVFRWSAIEFGLERLLLGTMITYFLFPGAPSIYYGDEQGFYVLDNTANNYLYGRQAMPSSIAWKVHGCYALASDQYPELPVIKAYQGCNDDWNIMDHFDFAKPELKMFKIFNFIREQYPALKSGWKSVKLRNWTEYVHFPNSGKTPTEVGVWSIVRGALETLQNFDARNNTAWNGDIWILYTNQNRTTTLDYQCSSSNSVVSPYASGLTLKNLIYPFEEYILQESNKYSSNLKSYYGCIPNIEFPPWGFKILIPKKYYVRYPPQITSFNPQHDSRIYNHNGKQKLVISFTETMDCNEITSKLQFSSKTESGKVMKVDKETVKCSVSNNSADSYYFGLAPARFHWSGDLINIADGIHEIKLQRVHSQDHQSMSDSMYKLLLRFGKLDNPMVFSTANRSSSILSQENEKLYINHKAPGADLFRFSFDYGLHWSEWIDYLSNKTECTEFANNISLKTWKGHHVIVQYWSRLTASANYIQEGGLGSLSSFPHLYMNGPYNQWGFDSGIPNRLIYKNCSWHKTFISDVFPTKFQFNVYNFDESGMPDQKKVYGTIGNSTVLVRLPPSELKESVTWIKEAPPSNFLTWEIIISDLTRTYHLIPRGSSTVSIILFSLFLVSPLICALATMLAFQKFFYQVRLNKGIEKKQEWKEKLLGPFSRISQSNINQGFSHQVALNNSVKSVHPKISRKLILVATLEYDIPDWDIKIKIGGLGVMAELMGKHLTHHDLIWVVPRVGDVNYPDGQELAPLEVVVLDQVYEVRVYSHNLRNITYILLEAPVFRKQTSAEPYPARMDDLSSAIFYSAWNQCIAGIIRRYPIDVYHINDYHGALAPCYLLPNVIPCVLSLHNAEFQGLWPLRTQAEKNEVCAVYNISTKICTKYIQFGNVFNLLHAGVSYIRIHQKGYGVVGVSNKYGKRSKARYPIFWGLKKVGKLPNPDPLDTAQLDDPTNITEEITIDLTAEAEKRAFKRDAQKWTNLELDDSADLLVFVGRWSMQKGIDLIADIAPTLLQDFNAQLITIGPIIDLYGKFAAEKLNALMKKYPKRVYCRPEFTHLPPCIFSGADFVLIPSRDEPFGLVAVEFGRKGALGIGARVGGLGQMPGWWYSVESNATSHVLQQFEEACRKALSSSAEKRALLRAKSAKQRFPVLEWISKLDHLMDNCIRLNVGQRQQGSSSHSMKFRSKNDLSSIKLSTKEGLENEENELKDKAPPNEPNVGSLFLFNKSSMGSVGGPGHYKATDLSQELETNDQDIEYNEFYSQLDTSTSDIFQDTSVDGFPDLQVSSDINVRNDRLSSFVMSSEDLRSSDGHPENSDSVLETISSVHHRSPINQVVRNLNESQLSLDSVISMNLNKEFALTKTENDFTDDNGRALNYFSQKLEELDPKNSVNELCIETFILKMKKEWYDGLRNIRFGIQRPNLLIYDEDKKFINTEHFLGSKVNLNSVTSLGNFNGSSPNSFLFLLKNRTMRIKCFMQMRIGDWPVYSIFLSVGQILAATSYQLVLLSGSSAQFSTQLYIVGSIYTVSSVFWWYLYRMLPSVASLSLPFLLYCASFLLIGISSFINENMYLRLWISHIASWIYAVASASGSLYFSLNFGDEAGAGVVSWIVRACIVQGFQQIWACCLWYWGSYIDRSMQECHSFPHEVYPLGLIAVFSWPLALVMLLFAILLIFGLPDYYWESPGNIPAFYTALLRRKLVLWFFVATILQNYWLSTLYGRSWKYLWGGSLLAPWKMLTIAFFLFLSMWIIMLMFLGRKSLTHSWLLPVFGVGLGSPRWLQMMWGTSNIGVYLPWAGVAGPIVGRILWIWLGVLDSVQGVGVGMILLQTLTRRHIATTLIAGQIIGTLTSMLARATAPNRLGPGLVFLDLTSWRFEDGAKIFRSAPFWICLISQIAVSAGYLLFFRRENLSRP

SEQ ID NO: 7517 - protein, 510 aa, Oryza sativa; identical to SEQ ID NO: 5984

SEQ ID NO: 7518 - protein, 75 aa, Triticum aestivum
GVHVRGARRPPAPCRDCGGACSYRCSKSSRPNLCNRACNTCCRRCNCVPPGTAGNEDVCPCYAHMTTHDGRHKCP

SEQ ID NO: 7519 - protein, 262 aa, Lycopersicon esculentum
MPTTMEDVTAKIDAVEIDSKSVVALKEKAIEGEVKTTETTQEKTNEAKSNPEKESNGATFKEEEVPVEVEPKTGVSFPVKLEDGKQLKAVGLRKKSMLGMGIKIYGFGIYADNEKLKDLMQSKIAKAPAKPTKEMYQMVIDSDLGMMMRLVIVFSNLTMNMVRKNFDEGLGAAIKKLTGGKNEELTKKIMGEASDDIKLNSGSVIEISRLPGYVLQTKVKGEIVSKVESELLCRAFIYMYLGDDPFDKEAKEKFGTSMLSLF

SEQ ID NO: 7520 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVPAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 7521 - protein, 772 aa, Neurospora crassa
MSNAGKDSGRNSPVPGNIPVRPSSPGGSFRPGSFRPSSFRARELGTSIPRADSIARLATPVLPQQQPSGTPTPIPIERGDAGALPPLPGAGSQSAGPGVSALAAALSNTYGASPPRFGTPPARALSPAPSAAQLQRSATPTTNYGSFETRSRLPSTGINGFGAYEDPEIIKRHLVQPGDSAGEETGERSKGKQPAEDDDEFSSLQLQGGDITRPIYRWAEEIEQRNKAKRSHSFSYPRPEPENEVLDINSIKVPGGFRRNYLRRNARDPSAHPDDSENGAGQGAPPPRLLTTSFLEFLSLYGHFAGEELEEDDEVLQPGEYFTSGSDEGEWWSDEGSVDDHEPMEDSTLLTPSRRKRRRKERGGSGRNSPMSAAMLLLKSFVGTGVLFLPRAYLNGGMVFSNAVLLFVAALSYYCFVLLVSTRLKVEGSFGDIGGILYGKWMRNLILFSIVISQLGFVAAYIVFTSENLQAFILAVTNCKTYISISWLIIMQMIIFLPFSLLRDIGKLGFTALIADAFIVIGLAYLFYYDVLTLNTSGLADIIMFNQKDWTLFIGTAIFTFEGIGLIIPIQESMRNPEKFPKVMAVVMIIITTLFTVMGAVSYAAYGSKTETVVLLNLPQDNKMVNGVQFLYSLAILLSTPLQIFPAIRITENALFTKSGKYNPYIKWQKNVFRFFVVAFCAMVAWAGADNLDKFVALVGNFACIPLVYIYPPMLHYRGVARSALWKFSDVALCVFGFIAMAYTTTLTVMSWAGAGEGGESPGYCDAKGLNP

SEQ ID NO: 7522 - protein, 434 aa, Medicago sativa subsp. X varia
MVNTSEENNSNAVMPRKFQGGMNQVGHGGGRIVGQNRRALGGINQNFVHGRPYPCVVHKRVLSEKHEICEKKQADLGHRPITRRFAAKIAGSQQSYAEKTKNSNPLNLNEFGNSIAIDDELKSPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 7523 - protein, 324 aa, Neurospora crassa
MSNSLEQLKATGTVVVCDSGDFATMAKYKPQDATTNPSLILAASKKPEYGALLDAAIADAKKGPGSPEEKVDAALDYLLVQFGKKILEIVPGKVSTEVDAALSFDTKASVDKALHIIKLYEAEGISKDRILIKIASTWEGIKAAEILQRDHGINCNLTLMFSLTQAIAAAEAGAFLISPFVGRILDWFKAHTGKNYSKEEDPGVASVKTIFNYYKKFGYKTIVMGASFRNIGEITELAGCDYLTISPNLLEELLNSDAPVPQKLNAADAASLSIEKKTYINSEPTFRFDFNEDQMAVEKLREGISKFAADAVTLKEIIKQKLAE

SEQ ID NO: 7524 - protein, 405 aa, GIBBERELLA ZEAE PH-1
MAQVLLDLFYSFGNCLNCFPGNPNLKINNRSFKILRLLGEGGFSYVYLVEDTSTHELFALKKIRCPFGAESVQQAMREVDAYRLFSHVPTIISAIDHSVATERGADEATKTVYVLLPYYKRGNLQDMINANLVNHDRFPERRLMLLFLGVCKALRAMHDYKPAVERMNMGREEDELNNGERNNTRGKRTEEEEEGEQERGLLEGESQVNGGRSIQHYSHRDIKPGNIMIDDTGSTPILMDLGSVAPSPIPVTSQSLALQIQDTAAEHSTMPYRAPELFDVQTGMVIDTKVDIWSLGCTLYACLVGKSPFEMRSDETGGTLSLCVLGGDWRFPDEGPAGVKRNNSMRPQQGQSQQQQQQAPAVEISEPIREVVRKCLCVEPAERPDINELIQMVQTVIEELPDDSN

SEQ ID NO: 7525 - protein, 191 aa, Zea mays
SKLSDKKKKKKKKKKKKKKKKNPRPQHNRLAFPSPPARLSLLSDSLSRSRVHLAAASKRDQRAPLGDGGAAAAAASNNLGGSFGEMLIDFVPDVAGLSLAESGGFVKAPGGAPANVACAIAKLGGSSAFVGKFGDDEFGHMLGNILKQNNVNAEGCLFDKHARTALAFVTLKHDGEREFMFYRNPSADMLL

SEQ ID NO: 7526 - protein, 159 aa, Triticum aestivum
  unsure (1)..(159): unsure at all Xaa locations
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEQXXPPGNXNGXKXTIWKLPXFGXNRXXKXAQQGXEVKKXYLIVSPVNRFKKSEWAQCFRHKELEG

SEQ ID NO: 7527 - protein, 461 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTHQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMG

SEQ ID NO: 7528 - protein, 325 aa, Bacillus anthracis str. A2012
  unsure (1)..(325): unsure at all Xaa locations
MLVISAKEQRDLVNMNEVIAYAALALQEFSAERTITPIRTSLPFANEKNTAXXMPSVAEGLEVLGLKVVTVVPHNKKIGKKTINGIVMLSDFQTGEPLALLEGSYLTMIRTGALSGVATKYLARHNAKTLCIIGTGEQAKGIAEAVFAVRDIERVMLYNRTEEKAYAFSQYIQKRFNTPTYVHKNANEAISEADIIVTTTNASTPVFSEKLQKGVHINAVGSFRPNMQELPSHAIANANKVVVESKEAALEETGDLQVPVREGLFEASDIHAELGQIISGEKAGRESDEEITVFKSVGLAVVDIIVAKYLYEKAVERGGGSRIEF

SEQ ID NO: 7529 - protein, 237 aa, Triticum aestivum
MDISSFVTSLLTSFVIFAVLVLVFTWLSRRPGNAPVYYPSVLLRGLDPWEGRGRGTRSPVGWIRQAFAASEADVVAASGVDAAVYLVFLSSVLAILAFSGIVLLPVLLPVAGTDHALEHSTGLTIGRVPRNVTDFERLALGNVQNLSMRLAAGPLAAYCGSLATCPGRRQSSKHVSNLRAAARSTSDVKPEELAVLLRDVPIPPPDQTIKDSVDSYFRVLHPDTFYKAMVVTDNKEA

SEQ ID NO: 7530 - protein, 225 aa, Ehrharta erecta
IENKISRQVTFAKRRNGLLKKAYELSLLCDAEVALIIFSGRGRLFEFSSSSCMYKTLERYRSCNYNSQEAAPENEINYQEYLKLKTRVEFLRTTQRNILGEDLGPLSMKELEQLENQIVVSLKQIRDKKNQALLDQLFELKSKEQELRDLNKDLRKKLQETTGDNVLHMSWQDGGGQHSGSSGLTAEHHQGLLHHQDQGNHSLQIGYHQAYMDHLNNEAEMAGHN

SEQ ID NO: 7531 - protein, 200 aa, Zea mays
MAEPGLEGSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLSEFRKIQQ

SEQ ID NO: 7532 - protein, 564 aa, Kluyveromyces marxianus
MSEITLGRYLFERLKQVEVQTIFGLPGDFNLSLLDKIYEVPGMRWAGNANELNAAYAADGYARLKGMACVITTFGVGELSALNGIAGSYAEHVGVLHVVGVPSISSQAKQLLLHHTLGNGDFTVFHRMSSNISETTAMITDINSAPSEIDRCIRTTYISQRPVYLGLPANLVDLKVPASLLETPIDLSLKPNDPEAENEVLETVLELIKDAKNPVILADACCSRHNVKAETKKLIDITQFPAFVTPMGKGSIDEQHPRFGGVYVGTLSSPEVKEAVESADLVLSVGALLSDFNTGSFSYSYKTKNIVEFHSDYIKVRNATFPGVQMKFVLQKLLTKVKDAAKGYKPVPVPHAPRDNKPVADSTPLKQEWVWTQVGKFLQEGDVVLTETGTSAFGINQTHFPNDTYGISQVLWGSIGFTGGATLGAAFAAEEIDPKKRVILFIGDGSLQLTVQEISTMIRWGLKPYLFVLNNDGYTIERLIHGETAQYNCIQSWKHLDLLPTFGAKDYEAVRVATTGEWNKLTTDKKFQENSKIRLIEVMLPVMDAPSNLVKQAQLTASINAKQE

SEQ ID NO: 7533 - protein, 1081 aa, Oryza sativa
MANGLMCLLIFVGTNGETYFNTASLVTCIQNFPKSRGPTVGILKGFAGLSSAILTQLFAVLHTPDHATLVFMVAVGPSLVAIGLMFVIRPVGGHRQVRPSDNNSFMFIYTICLLLASYLVGVMLVQDFVQLSDNMLVFITAVLFILLILPIAIPVTLTFSSKTEHPMEEALLAEPSKGQASTSQEKEPDVFLSEVEDEKPKEIDSLPPSERRKRIAELQARLVQAAARGGVRIRRRPHRGENFTLMQALVKADFWLIWLSLLLGSGSGLTVIDNLGQMSQAVGYKDAHIFVSLTSIWNFLGRVGGGYFSENIVRERTYPRHIALAFAQILMAAGHFLFAMAWPGTIYVATFLVGLGYGAHWAIVPAAVSELFGVKHFGAMYNFLTVANPTGSLIFSGVIASNLYDYEAEKQAHHQSSLSGRSLFDMSFLAEGARATYAIKAQNLCPSLEGISQMVSTLEVHLAAESKIDGESDWYRILSLTAFADEEEVKKQYRKLALQLHPDKNKSVGAEEAFKLISEAWSVLSDNSKKVLYDQKRKDHSVVNVTNGMYTYDKKANKRARKNAAAAAAAAAAAAAAAEATTRPAGVDTFWTSCNRCRMQYEYLRIYLNHNLLCPNCHHAFLAVETGFPCNGSSSSFSWSTKQQPQNNNSTKHSYGSTSRTSSIPGTGHGGYQQDGTYDSYNNQSFQWNQYSKTTPAAGTNAYGETVAASTETTAFTDVAVAQVNGTSGEKLRSAVSGRRANVLREISQIDTRALLIEKAKAAIQEKLQEWNITSSSRLAERGKSQGKVYPSDNNIKQNGGLSDKHVKGLKQCSSRSVDTQAPTVDEKNPEQRRVPVSIDVPDPDFHDFDKDRTERAFDSDQVWATYDSEDGMPRLYAMVQKVLSMRPFRIRMSFLNSKSNSELAPISWVASGFQKTCGDFRVGRYQISETVNIFSHKVSWTKGPRGIIRIVPQKGDTWALYRNWSPDWNELTPDDVIYKYEIVEIIDDFTDEQGLTVIPLLKVAGFKAVFHRHMDPKEARRIPKEELFRFSHRVPSRLLTGEEGNNAPKGCHELDPAATPVDLLKVITEVTEDTATQPAK

SEQ ID NO: 7534 - protein, 115 aa, Actinidia deliciosa
MVPKTFSMLLLLIALSAAVVGGRKQVVLGGWRPIKDLNSAEVQDVAQFAVSEHNKQANDKLQYQRVVRGYSQVVAGTNYRLVIAAKDGAVLGKYEAFVWDKPWMQFRNLTSFRKV

SEQ ID NO: 7535 - protein, 295 aa, Bacillus anthracis str. A2012
MKRVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLIEEYDKTLSSVIGVQTVPEDETHRYGIIDPLEQEGRRYQVRNFVEKPAAGTAPSNLAIMGRYVLTPEIFMFLEQQHVGAGGEIQLTDAIQSLNEIQRVFAYDFEGKRYDVGEKLGFVQTTIEMALQHPELRDDMVTMMKKILEEQTNQES

SEQ ID NO: 7536 - protein, 308 aa, Nostoc punctiforme
MAVSVVKKLDKLTTTELSAWVQQAKIQAKQGRVLDRIPQLALADPDWFAVHVCCESGKNISFGDTACIFPLMSVIKTFSLLYLLEHFGAETVFSWVGVEPSDAPFNSLEQLVSDRGRPRNPMINSGAITLADKLPGKDATQRTLLFCQWLNQLAGCQLSLDEVMLASVRLTRSTANEAITNYLTETGYLENLEIALDTYEQICCISGRIKDLALLGKLLACDGLVNPQNRRIVNAVMLTCGLYEASAEFAVRIGLPMKSGIGGGLVAIVPGEGAIACYSPGLDNIGNPVAGLVFVEAFSQKLELSIFG

SEQ ID NO: 7537 - protein, 1565 aa, GIBBERELLA ZEAE PH-1
MRETIQSYIVRISPPGSDKASPPVKGRDKGKAPRKRVGLTQVYPEPGSKRNHQKLKNDIIALHGLDATSPETWIGWKVDGDPNSGDVNWLEDKHMLPRFMPDSRILTYQWNANYDAYASSDRFSGHATSLLQDLHADRFSECRSNCPIIFIVSCFGGLLLAQALVIASHPTEPGHRQHSSILRHTIGAAFLGTPFGGSPLDDLANQFGNLIHSDKYKFPVMCVYETRHTDLSAYKRRLGANFSSMGLDENYHGIVVDSKSATISGMEAYGFDVRHNMLHKFNDSNDVNFKKIRHWLVKTADIAGETLGCKASNDRPVNDLYDDRSHSGSKSDTRLFDLPGSRVRKNPRKPEAREKLYNKLHFKTLGERYKNIWPAHRATCKWLLKNKEYQAWLDKGKLEDHHGVLWLKGNPGTGKSTLMKFAVSKLSMENPKDIHIFFFFNARGDALEQSTVGMYQSLLHQLFSQIPRLKYVFDDFAQFDLPETDIYESWALQTLESLLMHAISELGSHKLWVFVDALDEGNEKEVRKMITFFGGLGKEAKDANVDMRVLFASRHYPQITISHKVEIILESEKEHYLDIKRYVQSELYIKDGMTAQGIQDEVINRASGFFLWVVLVVEILNETAAKGMNQKEKLKELPDHLSTLFEGILTRDRENMKGTLLCIQWVLFSRKPLTREELYYAILHGANEKETRSWAADYVTIEIMDAFILTCSKGLVQFSGETAQFIHETVRDFLIHDNGMQLIASDATKSIKGAAHDTLKSCCLNCISSTLKIIWGSGRPVRFDNLDRLRGIYDSIVESGRKNYSKSKPLYKTPFLHYALFHLLHHANAAEAGGVSQVSFIQAFQLRSWVYLRKVFLELGTFNSLRSTFLYTLAEEGLGSLIMAMLHADPGKTPHLLVEELLRHEDVELNFRDAEKGRTPMWCDAEEGYEAIVKLLLERQGVDVESKDTEYGQTPLCVAARFGHREVVRLMLYGSSLAGSLKLFSSPRPISHPSHSLRCWNRDAEFNMAYQREFEMQAIPPPSPKTLPSTEPSSNTPTPDPDPDSTSPGALHRLLTSFTRAPPPSHSEDEYSLSSYNTSYATNGRLFNMSKANYNSANTALARELKNRHLQMIAFGGSIGTGLFVASGVALFRGGPASLLIAFITMGTMQFFTMQALGELSVAFPVGVLPLEIIAGAFTTNYWNPDASKSIFIILFFFLILGINLLGVKGYGEAEFIFSAVKITAVMGFILLGIIINIAGEPEGGYIGFSHWQNPGAFNNGFKGFASVLVTATFSFAGTEMVGLAAAETSNPKKSLPAAVKQVFWRISLFYILSILLIGLLVPYNEPRLLGAKYGSDAAASPFVIAIEMSGSDILPDIMNAVILISLISVGNTAVYASSRTIAALAEQSLAPKIFAYIDRAGRPLIAIICCGTVGLLAFVANSDIHNEIFNWLLAISGLSTLFTWASICVCHIRFRKAWRLSGYKLSQLAFKSQVGVWGSWVALAAYTTVLLLQFWVAISPIQPTDQAPFTTPERIKNFFLQVLTVPVILIFYIVHKLWMRTKIVRDKDIDIHTGRRYLQEYAAY

SEQ ID NO: 7538 - protein, 108 aa, Oryza sativa
  unsure (1)..(108): unsure at all Xaa locations
NREAQXWACVRKEAXSSDKNEYSHLLVSDFSDTTPSLPPEELPPFMVCSLEMAHEMPPAEQELGIEVRPRAPREVAGRNPALVFLESXLPWVDYGDNHHDENDQNNDD

SEQ ID NO: 7539 - protein, 349 aa, Xylella fastidiosa 9a5c
MFINAYGAHAGDKPLESMQIARRVPGAHDVQIDIHYCGVCHSDIHQVRSEWAGTLFPCVPGHEIVGRVSAIGTHVKGFKTGDLVAVGCMVDSCKDCQECNAGLENYCDGMIGTYNFPTHDAPGHTLGGYSQKIVVDERYVLRIRHPEAQLAAVAPLLCAGITTYSPLRHWNAGPGKKVGIVGIGGLGHMGIKLAHAMGAHVVAFTTSESKRQDAKALGADEVVVSRDEESMAAHVKSFDLILNTVAASHSLDPFLTLLKRDGTLTLVGAPATPHPSPQIFNLIFKRRSIAGSLIGGIAETQEMLDFCAENGIVADIELIRADGINEAYERMMKGDVKYRFVIDNATLAA

SEQ ID NO: 7540 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLERVGAEVVECACVIELPELKGRQRLKGKPLCMLVEYR

SEQ ID NO: 7541 - protein, 441 aa, Zea mays
  unsure (1)..(441): unsure at all Xaa locations
VAHFAPEXIPERVVHARGASAKASSXCTHDVTXLTSPLPPPRSSEALIMRFSTVIHERGSPETIRDPRGFAVKIYTREGNWDLLGNNFPVFXIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIQKPNDFKQPGERYRSWDANRQERFVRRFADSLGHPKVSQELRSIWIDLLSKCDASLGMKIATRLNMKPNM

SEQ ID NO: 7542 - protein, 228 aa, Guillardia theta
MFFCSYFNLINCNLFRYYLVKNTCLKTNYSNNKKKSKVNNLTFLKSNEDNQLVKENTINIDEERDKMFDTILQELSAIQQNAPRRVAILGTRHFSYLHQQIVELLTYANILVGNHVFTSGGAVSGTNAAVIKGALRAEKPELLTVVLPQSLSRQPPDVRELLEKVRNVVEMRENDDLPLDVASRLCNSNILSRCDHLISFAFHDSVVVLEAAREAKALNKLVTLLYLD

SEQ ID NO: 7543 - protein, 212 aa, Zea mays
  unsure (1)..(212): unsure at all Xaa locations
QDAPMFVXGVNEKEYKSDINIXVSNASCTTXNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAESEGSLRGILGYVEEDLVSTDFQGDSRSXIFDAKAGIALNGNFVKLVSWYDNEWGYSTRVVDLIRHMNITK

SEQ ID NO: 7544 - protein, 285 aa, Saccharomyces cerevisiae
NVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 7545 - protein, 2420 aa, Aspergillus fumigatus
MKWGWTGALLAWFATTTSCWPYDESLVGYNLNENKEAKSPVEYWGEWPDHKGKYFPSPENWRFPFYTLFLDRFVNGDPENDNINGTQFEHDISSNQMRHGGDVAGLVATLDYLQGMGIKGIYLAGTILMNQPWGADGYSTLDTTLLDQHFGNIDTWRNAITEIHKRGMYVIFDNTIATMGDLIGFEGYLNTTTPFSVKEHKALWKTDRRYVDFDIGNDYNSTCDYPRFWYEDGLPLPSEQADQLVGCYNSDFDQYGDIEAFGVFPDWQRQLAKFASVQDRLREWIPSVRERLIRHSCIIIASLDIDGFRYDKATQATVDALGEMSMAYRECARAVGKNNFFISGEITGGDYFGSIYLGRGRQQNQWLPDPSQGPKMTNESSAQYFLREAGHEALDSAAFHYSVYRTLTRFLGMDGNLAAGYDVPLDWVDMWRQMLRSNDLVNANTGKFDPRHMYGATNQDVFRWPTVQWGVERQLLGSYITTLFLPGILLLLWGEEQAFYVLDATATNYIYGRQAMSPATAWRDHGCFSLNSSQYYKWPIQAGREGCHDDTVAYDHRDPSHPVRNILKHMYQLREQFPVLNDGYTLNNLSKSTFPVQYPGSNGTETETGMWSVSREANLEVQDFGSDDLNSPVWMVYQNDNHTVDYKFDCNSETDALVAPYPADTVVKNLFYPWDEFTLTAGPTKRTFGNATLPAGCYGNLTLKAFEFRAYVPKKLHRKPRPMITKFSPGHDVPIASTVAPDASENVPIELHFSEEMDCDGVTKSISLTSSTESLKIPSIDAGSVHCERITNFNTSWTAQIPSMWKWQATLTNVYNGIHQITVKEPKTSSGNASTNSTDHFLFRIGQVDNPMVFTRANYSTSLLHEYENGTLFIQHHAAGADKYRYSTNWGTTWSSWTKYHGGNDTIEELPWQGTKEQRWEGKHVRVEYWSGLTGSSDYYQEGDVGWPHQVPRGFPHIHFNGPFNQFGYDGGLPNKLKLDTTTGHWKYHFTYEWPAQAQINVWGMNPDGRPDQSWVLGDIDGDHVLDRMPPSSLSATMINITDLPPSPHLAWIISINDGTMRYTLEPTGDQSTQMAMYILFWIVPLLTGAVCVYVFMKSFYQVKFNQVGVSEKRTLIPLALRRKLKRARNGEGEAMNPLMRLANKSGFLQSATDLTAASGGSKRRMVLIATMEYDIEDWAIKIKIGGLGVMAQLMGKTLGHQDLIWVVPCVGGVDYPVDRPAEPMIVTILGKPYEVQVQYHILQNITYVLLDAPVFRQQSKSEPYPPRMDDLDSAIYYSAWNQCIAQTIKRFPIDLYHINDYHGSLAPLYLLPQTIPACLSLHNAEFQGLWPMRTEKEKEEVCSVFNLDKEITRRYVQFGEVFNLLHAGASYLRVHQQGFGAVGESKKYGKRSYARYPIFWGLKKVGNLPNPDPSDVGEWNKEKALAKSEDPPVDQEFEAGRAELKRQAQEWAGLEQNPDADLLVFVGRWSMQKGVDLIADVMPAVLEARPNVQLICVGPVIDLYGKFAALKLDRMMKVYPGRVFSRPQFTALPPYIFSGAEFALIPSRDEPFGLVAVEFGRKGALGIGARVGGLGQMPGWWYNVESMTTAHLLHQFKLAIEGALNSKPEVRAKMRARSAKQRFPVAQWIEDLEILQSTSIRIHNKEASKSNNRPVTPTGPMTPRGLGTMSPTFPGSGTQTPVGTHSREASYVNLRQLSEIGPQQRDTIISYSNNNAGREMTEKPAPGLSRKLSLGVRSGPGHINRPGRRGQGQQDLALPDRRDGGDVSDIEEESDEDFIDQYYGDEEYTLTPEQAEEGRRLQNNPQSQSGRATPRELTRSSQFPSSPSVHSDMGLAPPTRPFLEPGNRLSSASVLSVDSVVGDKKDFKLQKVDPFFTDSHGEYARLFEKSLENLNAANSETQLCIEEFLVKSEKEWFDKFRDAKLGRLNSPAPSVFRGKRGPSPVDSYYGDDASSRMSPDDEQSQEDDEFLLGKDYVPPTGLRKWMQLRIGDWPVYSLLLGLGQIIAANSYQITLLTGEVGQTAEKLYGIATTYLITSILWWFVFRYFKSIVCLSVPWFFYGLAFLLIGLAHFDHNEFSRGWIQNVASGFYATASFSGSIFFALNFGDESGAPVKEWVFRACVIQGTQQAYVIALWYWGSTLTKASSQGLLTAETNIANTWKMTAICVPITVFLWCVGLLMFFGLPNYYRQSPGKVPSFYRSVFRRKIVIWNFAVVIIQNFFLSAPYGRNWNFLWSSAHAKTWQIVILCIVFFGFVWAGFLFVLSHLSKKHSWILPVFACGLGAPRWAQIWWGVSGIGYYMPWVAGGLTGGALASRSIWLWLGVLDAIQGLGFGMILLQTLTRMHMCFTLIVCQVLGSIATICARAFAPNNVGPGPISPDPTYGASAVANAWFWIALIFQLLICAGFLLFFRREQLAKP

SEQ ID NO: 7546 - protein, 470 aa, Eremothecium gossypii
MPGNQVGTDGAGAVDVAALANAAWVGASSVLIWMMVPGAGLLYAGLSRRRHALAMLWASIMAVTVVSLQWFAWGYTLAFAPATRGNGFLGTLHYAGMYHVLDAAPKRALPTAADVLFQGMFAMVAGTLMIGGSGGHARLLPMLVFLFWWVTLVYCPVACWTWNADGWLARMGVLDYAGGGPVHLTSGHAALVYALILDSRRGRRARRPRKFRPHSVTMVVLGTVFMWFGWFGFNGGTAGSPTALAFYGCVSSNLAAGCGAIVWLFLDYFRYGKKWTVVGLCSGAISGLVAITPAAGYVPAWASVAIGAFAGFSCIFAVAIKIVLGIDDGLDVYAIHGVGGAVGSAMTGLFACKYVNASGAPYVRPIEGGWLERNWAQLGYQVVAILSISAWSAIVTALLLLLLDRIPYLRLRPAADEQEDVDIHGINLFVNDVHDRVAEKIGVTSHAASTSRDQEAAKPRETPELDAVVS

SEQ ID NO: 7547 - protein, 170 aa, Helicobacter pylori
GSGMHTHVSVWKNNENLFSGKTYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 7548 - protein, 558 aa, Xanthomonas campestris pv. campestris str. ATCC 33913
MWEALGTVRDLGRLQEIASVLIRYGFGDVVRRIGLADVLERAGRLLHWTNAEGRLRMSAATRVRRALEELGPTFVKLGQVLATRVDLLPPDWIEELSELQNAVPALPFAHIRPQLVAALGMEPEQVFARLDEEPLAAASLAQTHRAWLADGTAVVLKIRRPGIGDTIDADLRLLARLAEIVETRAPDLKRYRPAEVVQQFTLSLRRELDFAAECRNAERIAANFANDPQILIPAVHWEWTCESLNVQDFVDGIPGRDLVAVDAAGLDRKALARTGAGIVLKMVLQDGCFHADPHPGNIFYLRDGRIAVIDFGMVGRISEQRRFQVAQLLHGMVSYDAESVIDVLLEWAGTSLDIDEPRLQQDIGAFVDAYRGVPLKELRIGAMLGDVTAILRDHGLTLPSDLALMIKAFLTLEGMGRQLDPDFDMASEARPYLERVVLQRYAPSAMLRRGRRTVTGAIDLIGDLPRDLKRLIQAARRGKLQLHVETRALREFGEQVDRAANRLTMGIVTAALVIGSSIVMNSVGGIASRWLLALGVSGFIGAALCGVWILFSIWRSRR

SEQ ID NO: 7549 - protein, 442 aa, Coxiella burnetii RSA 493
MRWVIVVKDDESNIKAFHWRIVFTAGMGFFTDAYDLFIIGVVTTILTPIWHLTISQLALLNGAALAAAAVGAISFGVLSDKFGRKRLYGVEVLILFFGAILSAFPPSYGWLLFSRIVVGLGIGGDYPSSAIIASEYAPSQRRGFLVLLVFAMQALGLVVGPLLASLLLVTPLSHTLVWRILLGIGAIPAASVFYLRRQIEETPHYLLKKSPPVAVSRVVSDLTGFTKKIKAQQVPHPQHYLFEKKWLVRLIGTASAWFLLDVAFYGNSVSSVLILKWLNPQAQLVTNTLLTALTFFVFAVPGYLLAATYIDRIGRKFLQMFGFFMIAVAYGAIALIPHLTQHIPLFIAIFGISFFFVNFGPNTTTFLIPSEIYPTSLRARAHGISAAWGKVGAFVGAFFLPHILHTQGLRYTMALLAVVCLIGILVTLLLPEMKGKAIDVIE

SEQ ID NO: 7550 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 7551 - protein, 208 aa, Fusobacterium nucleatum subsp. vincentii ATCC 49256
MDKVSHISNMANIYYVRQNMPLGLGHAILKAKSFIGDEPFVIALGDDIIYNPEKPVTKQMIEKYELYGKSMIGCQEVAKEDVSKYGIAKLGDKLDEATFQMLDFLEKPSVDNAPSRIACLGRYLLSGKVFKYLEETKPGKNGEIQLTDGILAMMKDEEEVLAYNFIGKRYDIGSKFGLLKANIEFGLRNDETKEDIKEYLKNLDIEKV

SEQ ID NO: 7552 - protein, 579 aa, Cytophaga hutchinsonii
MLSKTVSDQLVAMLVQAGIKRVYAVTGDSLNFVNDAIRRSGKIEWIHVRNEETGAFAAGAEAQLKGIACCAGSSGPGHVHLLNGLYDAHKSSASVLAIASTCHSTEFGTDSFQETNTIKLFDDCSCYNQIAVTPLQFPRMLQAAVQHAIHKKGVAVLGLPGDLTSMAAELSPTSMEIYHSNPVIRPSAVELIQLAAILNDHSKITIFCGIGASEAHDQVVKLSKVLQAPVAYSFKAKMSMQHNNPNEIGMTGLLGLPSAFESMHESEVILLLGTDFPYADFMPVKNKIIQIDTAPEKLGRRAKLDMGLCGNIQDTLDALFPLITQKEDDSFLQKQLNLYTEVKEHLKSYVDDPGKENLIHPEYVASRIDALSAEDAIYTVDTGMTCVWAARYLNATGKRTLLGSFNHGSMANAMPQAIGAALACPGRQVIAMCGDGGISMMLGDIMTIVQYKLPIKLIVFNNHSLGMVKLEMEVSGLPDWQTDMVNPDFSKIAEAMGMRAITVTDPADVDGALIEAFAYSGAILLNIITDPNALAMPPKITFEQMKGMATSMTKLMLSGQMDEVWKKIESNKKHLKELL

SEQ ID NO: 7553 - protein, 145 aa, Magnetospirillum magnetotacticum
MDDVTETLLLVLVVVTALAFDFTNGFHDTGNAMATSIATKALKPKTAVALSAVLNMVGAFLSLAVAATIAKGLVDADVITLEVVLAGLVGGITWNLLTWLLGIPSSSSHALIGGVVGSVLADVGTQGVIWSGVTDKVVIPGLFAR

SEQ ID NO: 7554 - protein, 226 aa, Zea mays
MDHEKVAPIDEKAPHGVSQPTVSSQEEYTGDWREQEDFMTRNGLNLKSFQRRPKGGELVVLDKSMKTRHLHMIAIGGSIGAGFFVGSGAALAKGGPASLLLDFSIMGVMIFNVVYALGELAVMYPVSGGFYTYSTRFIDPSWGFAMGWNYVFQWAIVLPLEINVAAITLEYWPGARNVHVAVWMLIFWLFIVIINVFGTLGYAEEKFWSSLLKLSATVIFMIIALV

SEQ ID NO: 7555 - protein, 1324 aa, Oryza sativa
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGFCIMILQAGYRFLEDRGISLSLPSSCIDSKGRTALSNSIQAPFRAYRVDDVLSYKEIGAHDFHFAAWCLDAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVRKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSET

SEQ ID NO: 7556 - protein, 155 aa, Triticum aestivum
  unsure (1)..(155): unsure at all Xaa locations
MAATIQSVKARQIFDSRGNPTVEVDVCCSDGTFARAAVPSGASTGCXYKLWELRDGGSDYLGQGCXSKAVNNVNSIIAPALXGKDPTAQTELXDNFKGQPLDGTKNEWGWXCKQNFGANASCCTTTVCKLDHVKKXPLYQHIPTCWEQLVFPFRL

SEQ ID NO: 7557 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 7558 - protein, 405 aa, Thermobifida fusca
MQRHGDLPTARKTPRSGLPWPDAREAARRLGRRCGPGQLRWETLTEALGGVLADELQARIAAPPYDAAAMDGYAVCGPGPWTLHGRVLAGQEHDLVLSPGQAVEVATGARVPEGTTAVLPYEHARRNADVLAGDIAPGRHVRRRGEETPEGAVVLPAGTVITPAVLGLAASLAHDRLPVYRPRVRAVVSGDELVDEGVPSPGAVRDAIGPMLPGLVAAGGGVLTTLHRIPDGLDALTAQLAAEGDESVLVVCGASSVGPADYLRGALVELGAEVLVDGVHCRPGHPQLLAQLAGGRHSRRVVVGLPGNPGAALAASLTLLLPLLCAMTGRAETAPGRITRCRLDGEVTVHEHDTRLVAVEVLADRARPVGHDRPASLRGAAAADAVAVVPPRWAGDDVELLWLPV

SEQ ID NO: 7559 - protein, 359 aa, Capsicum annuum
MDSTNQNLTQTEDEAFLFAMQLASASVLPMVLKSALELDLLEIMAKAGPGAAISPSELAAQLPTKNPEAPVMLDRMLRLLATYSVLNCTLRTLPDGRVERLYSLAPVCKLLTKNADGVSVAPLLLMNQDKVLMESWYHLTDAVLDGGVPFNKAYGMTAFEYHGTDPRFNKVFNRGMSDHSTMTMKKILEDYKGFEGLNSIVDVGGGTGATVNMIVSKYPSIKGINFDLSHVIEDAPAYPGVEHVGRDMFVSVPKADAIFMKWICHDWSDEHCLKFLKNCYEALPANGKVLVAECILPETPDTSAATKNAVHVDIVMLAHNPGGKERTEKEFEALAKGAGFTGFRRACCAYQTWVMEFHK

SEQ ID NO: 7560 - protein, 139 aa, Chlamydomonas reinhardtii
YTRKGMFRAAVPSGASTGVHEAVELRDGDKSKYLGKGVTKAVENINAIIAPALKGMDPVKQAEIDQKMKDLDGTDNKGKLGANAILAVSMAVCKAGAAEKGVPLYKHIADLAGNSKLILPVPSFNIINGGSHAGNALAM

SEQ ID NO: 7561 - protein, 137 aa, Glycine max
  unsure (1)..(137): unsure at all Xaa locations
KNPSFESFPLSPLFPLSDSIPKQIPLSEDFASIFINLDCKLDLKTIVLQARNAEYNPKRFAAVIMRIRDPKTTALIFASGKMVCTGAKSEQQSKLAAREPRVRFXDFKIQITVGSCDVKFPTRLEGLAYSHGAFLKL

SEQ ID NO: 7562 - protein, 251 aa, Glycine max
MDAGYNPRTVEEVFRDFKGRRAALIKALTTDVEEFYQQCDPEKENLCLYGFPSEHWEVNLPAEEVPPELPEPALGINFARDGMQEKDWLSLVAVHSDAWLLAVAFYFGARFGFDKADRKRLFNMINDLPTIFEVVTGMAKKQGKEKSSVSNHSSTKSKSNSKRGSESKYTKAMQSKDEDDEGVGVEEEDEDEHGETLCGACGESYAADEFWICCDICEKWFHGKCVKITPARAEHIKQYKCPSCSNKRARP

SEQ ID NO: 7563 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7564 - protein, 488 aa, Botrydium becharianum
MSKNVQERTRIKSERYESGVIPYAKMGYWDADYNVKSTDVLALFRITPQPGVDPVEAAAAVAGESSTATWTVVWTDLLTACDLYRAKAYRVDPVPGTTDQFFAYIAYQCELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGINRAAASTGEVKGSYLNVTAGTMEDMYERAEYAKQIGTIIVMIDLVIGYTAIQSMAIWARKNDMILHLHRAGNSTYARQKNHGINFRVICKWMRMSGVDHIHAGTVVGKLEGDPLMVKGFYNTLLNTTLEINLSQGIFFDMDWACLRKTVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPDFVETATESK

SEQ ID NO: 7565 - protein, 360 aa, Bacillus subtilis var. natto
MRIKEHLKQLKPYQPGKPIEAVKSEYGLDKVVKLASNENPYGCSEAAKEALHHEIQQLALYPDGYSAALRTRLSKHLNVSETSLIFGNGSDEIIQIICRAFLNNKTNTITAAPTFPQYKHNAVIEGAEVREIALRPDGSHDLDAMLEAIDEQTQVVWICSPNNPTGTYTSEGELLAFLERVPSRVLVVLDEAYYEYVTAEDYPETVPLLSKYSNLMILRTFSKAYGLAALRVGYGIADENLIRQIEPAREPFNTSRLGQAAAIAALDDQAFIASCVEQNNAGLQQYYDFAKTHGLKCYPSQTNFVLIDFKRPADELFQALLEKGYIVRSGNALGFPTSLRITIGTKEQNEEILAILAEIL

SEQ ID NO: 7566 - protein, 762 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFISEAVRFIEDIQTADGSWYGNWGVCFTYGSWFALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 7567 - protein, 326 aa, Triticum aestivum
  unsure (1)..(326): unsure at all Xaa locations
MAAYQAGYIDLQFMDEKLPSTIREQNLTKMYENLKFPFEQKVDQKQTMLDPKNDIVQDTPMVLPAEGIPTASEQPTPAEEKETETVTQGTLPVQDEHGADTKLPSQDTLSVDIKPNVVNKAAGEVPLGQADKISSTVSPVESSPTTAEVQKDPLGADVGEQKSLAETYLLQEEHDIPKDVSAKETKSDGIVGGVKASDDGKIMLDIIDAIHAAEKKQADTDAYTYSEEKRKLKERYEKELKDTSARELMYAEEAAILDKELKKEKMKAAAAVKELQEKTEQKLMDELQRKDEEASQQVEKXKELAKAELAAALAKEKASXIEQIAE

SEQ ID NO: 7568 - protein, 114 aa, Nicotiana tabacum
MDTAQWPQEIVVKGMEEIIPKSINTITTICSSKPSTHVERKIRPHQKDQALNCPRCNSTNTKFCYYNNYSLSQPRYFCKTCKRYWTEGGSLRSIPVGGGSRKSKKSSSTNSSSS

SEQ ID NO: 7569 - protein, 250 aa, x Aranda deborah
MGRGRVELKMIENKINRQVTFAKRRKRLLKKAYELSVLCDAEVALIIFSNRGKLYEFCSSTSMLKTLEKYQKCNFGSPESTIISRETQSSQQEYLKLKNRVEALQRSQRNLLGEDLGPLGSKELEQLERQLDSSLRQIRSTRTQFMLDQLADLQRREQMLCEANKTLKRRFEESSQANQQQVWDPSNTHAVGYGRQPAQHHGEAFYHPLECEPTLQIGYHSDITMATATASTVNNYMPPGWLGQISGSYE

SEQ ID NO: 7570 - protein, 409 aa, Schizosaccharomyces pombe
MFRTCTKIGTVPKVLVNQKGLIDGLRRVTTDATTSRANPAHVPEEHDKPFPVKLDDSVFEGYKIDVPSTEIEVTKGELLGLYEKMVTIRRLELACDALYKAKKIRGFCHLSIGQEAVAAGIEGAITLDDSIITSYRCHGFAYTRGLSIRSIIGELMGRQCGASKGKGGSMHIFAKNFYGGNGIVGAQIPLGAGIGFAQKYLEKPTTTFALYGDGASNQGQAFEAFNMAKLWGLPVIFACENNKYGMGTSAERSSAMTEFYKRGQYIPGLLVNGMDVLAVLQASKFAKKYTVENSQPLLMEFVTYRYGGHSMSDPGTTYRSREEVQKVRAARDPIEGLKKHIMEWGVANANELKNIEKRIRGMVDEEVRIAEESPFPDPIEESLFSDVYVAGTEPAYARGRNSLEYHQYK

SEQ ID NO: 7571 - protein, 174 aa, Moorella thermoacetica
MAQNRHQALGLSDDTVLEMYETMLLARKLDERMWLVNRAGKIPFVISCQGQEAAQVGAAFALDRTKDYVLPYYRDMGVVLTFGMTARELMLAAFAKAEDPNSGGRQMPGHFGQKKNRIVTGSSPVTTQVPHAVGFALAAKMEKKDFVAFVTFGEGSSNQGDFHEGANFAGVHKL

SEQ ID NO: 7572 - protein, 196 aa, Brassica napus
MGRKKLEIKRIENKSSRQVTFSKRRNGLIEKARQLSVLCDASVALLVVSASGKLYNFSAGDNLVKILDRYGKQHADDLKALDLQSKAPKYGSHHELLELVESKLVESNSDVSVDSLVQLEDHLETALSVTRARKTELMLKLVDSLKEKEKLLKEENQGLASQMEKNNLAGAEADKMEMSPGQISDINRPVTLRLLY

SEQ ID NO: 7573 - protein, 337 aa, Oryza sativa
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSPDFQGDSRSSIFDAKAGIALSDTFVKLVSWYDNEWGYSTRVIDLIRHMHSTN

SEQ ID NO: 7574 - protein, 323 aa, Glycine max
  unsure (1)..(323): unsure at all Xaa locations
MVGVISLVTGMAGPSGFGSASTAEQVTEGVDASNLTAIITGGASGIGLETARVLALRKVHVIIAVRNMVSAKEAKQQILEENESARVDIMKLDLCSVNSIRSFVDNFIALDLPLNILINNAGVMFCPFKLSEDGIEXQFATNHIGHFHLSNLLLDKMKQTAKATGIEGRIINLSSIAHNYTYRKGIRFNKINERKGYGNKRAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 7575 - protein, 123 aa, Zea mays
  unsure (1)..(123): unsure at all Xaa locations
MNYLDGRPVTENYPIIDIDNYNRFTYNLCHDMVHLGLNFEGYRDDELTIQDVGTNNLRVILISSGAGEPQDSGISLHSVLEXTPTIPIFVDCMALQCIGQVFVGKITRAPSDXMHGQSSPGYY

SEQ ID NO: 7576 - protein, 422 aa, Nostoc punctiforme
MLITLVFVALLAFYVAWNLGANDVANAMGTSVGSKAVTLKQALIIAGVLEFTGAVLFGHEVTETLATKIANPALFAATPQILVTGMVTVLISCGVWLQIATSRGLPVSSSHAVVGAIAGFSWVALGVGAIDWSSIGLITIGWVLTPLISGAIAALFYSQIKHWILDQPNQVVQLQEWIPWLSTLLLGVFGVIVLPSLTEPLTNFVIEQVGFTIPTYDIPLLTGAVAAVGLTIISWRQLGDKIDKGDKGEILPNPVERLFGRFQLLSACFVAFAHGSNDVGNAIAPLAAIVYINRTGSVPTDGITIPLWILILGGAGIVGGLAVWGKKVIATIGENIIALQPSSGFCAELATATTILIASRLGLPVSTSHALVGGVVGIGLVQNIKSIKFQTLKGIAAAWLITIPVSALLSAAIFSIARILFH

SEQ ID NO: 7577 - protein, 365 aa, Cryptococcus neoformans var. neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 7578 - protein, 667 aa, Schizosaccharomyces pombe
MKYFLLPQTILMSSRALRKLQRQRQTELLEEALDSESDEDDEFSSTSGKKVVNVFEILEKENNAINSEAEKSVSEEEQDEPLVEGESPIVSTNKKAKNKKKKKKQQKKKKVTGKRDLDNQSSDNEKLEGLESSKNIDDDIDEIEKAAAELKLKYREQDQVEHVAGVEESATIPLDKELDEKLNKLLGVNISMLNPDLEIRKIFGRIVEKRSVNARHDNLRRKRHVLVQPQEGWPPLVRSGLGMKLTGQSQDLECFFEITQSRAYQEVQETFEYYVQTYDPNNLLMLLRSHPFHIDTLLQVSEIIDQQGDHELSAELVARGLYAFDSILHPRFNLATGATRLPFAIPSNRRLFLCIWRYLQSLQSRGCWRTVFEFCKALLQFDMSDPYAIGTCIDIYALRRREFAWIIDFANYLENSNKISDTPNMLYSSALAMFYVHGDTTDTRASMLAAFERAPYMLSELLDTLNISFTKSSIPSPQDPVQELHSAMYALYAKDSWSDPTVLAFINSILEKETVTLHDVEGQFAELTENLSRRVILLNEQSLRKFLPQRILQGTILSFDPLPPDTYLSESQVFGRDISRRIASFLSDYLSRAREVNENEEEPPAHEFDLPPAEQLLQQIESEVGEESEDGTPVMTRLRSFFGSLFTSTNSETEPAEESTEEMGQGD

SEQ ID NO: 7579 - protein, 350 aa, Ipomoea trifida
ERLAGSGIERIPKRYIRPEKERPSIGDIFAEEKMAGGPQVPTVDLKGINSEDLEVREKCREELRKAAVDWGVMHLVNHGIPEELTARVKAAGEGFFGQPIEEKEKYANDQAAGNVQGYGSKLANNASGQLEWEDYFFHCVFPEDKADLSIWPKTPSDYIAATREYAKQLRALTTTVYAVLSQGLGLEEERLEKKWRDGRASSTNEDNYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVCRADPPRFPPRTFAQHIKHKLFRLTDQEGADTPKPDE

SEQ ID NO: 7580 - protein, 475 aa, Staphylococcus aureus subsp. aureus Mu50
MRDYTKQYINGEWVESNSNETIEVINPATEEVIGKVAKGNKADVDKAVEAADDVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 7581 - protein, 287 aa, Zea mays
LQWAGTASIDFSLAQLIQVIVLLSTGGNNGGGYLASKHVVFAFHAGILLSHAVINSLSITWLSLLGQFAALWSMLGVLVLMIAVPVVATERASAKYVFTHFNTDNSAGIHSNLYIFVLGLLMSQYTLSGYDASAHMTEETKNAGRNGPVGIITAIGVSLVVGWGYILGITFAVKDIPALLSTGNDAGGYAIAQVFYLAFKGRMTYAFSRDGAMPFSSVWHKVNEQEVPVNAVWLSAFVSLCMALPSLGSLVEYQAMASVATTGVYIAYALPILLRVTLAHGRFVFEP

SEQ ID NO: 7582 - protein, 549 aa, Zea mays
MYQKKSHFCLCSANMALEPIALLLTVLIAAPLTVLLLFLVAGNKKAARAASPTPPRRRDRLRLPLPPSPRGLPLVGHLHLLGALPHRALMSLARAHGPVLLLRLGRVPTVIVSSAAAAEEVMRARDLTFANRPASAMAERLLYGRDVAFAPYGEYWRQVRRVCVVHLLSARHVGSFRRVREQEAAALAARVARDSAGGAAVGLSDLLTEYANAVVSRAAFGDESARGLLDEFDSGRRQRKVLSDLQKLIGTTPLGELLPWLGWVDAVTGLEGKIRRTFEALDGLLEKVIDDHRRRPRNGEDGSHRDFVDVLLDVHEKDQEHGIQLESNEIKAIILDMFAAGTDTTTTVMEWAMAELVTHPRAMRRAQDEVRAAAAGSTGVNEDHVAQLDYLKAVLKETLRLHAPVPLLVPREPAADTEILGYHVPARTRVLVNAWAIGRDPATWERAEEFVPERFLGGGAAANVGFKGQHFELLPFGAGRRMCPGIAFAEGSAEMALASLLYHFDWEASRGQNREGTPSLDMTEMSGITVHIKSGLPLVSKPWSGSPLN

SEQ ID NO: 7583 - protein, 165 aa, Zea mays
  unsure (1)..(165): unsure at all Xaa locations
MAGTIQSVKARQIFDSRGNRTVEVDVLRSHGTLAWAAAPRGAXTGVYEALEXRDGGSDYLWKGVCKDENNAYTDIVPAMIGMDPTAHTEIDNLMDXHLDGTNNEWGXSKQKLDAHAILAVXIAVEGGCSIITRNASYQLNVNLADNEHHELPVHAFNVINGGTHA

SEQ ID NO: 7584 - protein, 271 aa, Glycine max
MAVESDKVGSDGKVWSFCSMPFWQTTHASSSSSSTTTTIPTTSSMHHSVHHQSQILQSLDRSTHQPSTTVSSVAKSLLPTRRRLRLDPPNKLYFPYEPGKQVRSAIAIKNTCKSHVAFKFQTTAPKSCYMRPPGGILAPGESIIATVFKFVEPPENNEKPIDQKSKVKFKIMSLKVQGEMDYVPELFDEQRDQVAIEQILRVIFLDPERPSPVLDKLKRMLAEADAALEARKKPPEETGPRVAGEGLVIDEWKERRERYLARQQVEVVDSV

SEQ ID NO: 7585 - protein, 341 aa, Neisseria gonorrhoeae
MGIKVAINGYGRIGRQVLRAIYDYQIQDQLQIIAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGTLKGVLGYNTLPLVSMDFNHTTEASHFDATLTKVVDGNMVKVFAWYDNEWGFSCQMLNTARRMFGLEVRP

SEQ ID NO: 7586 - protein, 336 aa, Triticum aestivum
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 7587 - protein, 311 aa, Vibrio cholerae
MKVAVIGAAGGIGQALALLLKNRLPAGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEALLDIGKLSAYEQAALDGMLDTLKGDIQIGVEFVK

SEQ ID NO: 7588 - protein, 253 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 7589 - protein, 464 aa, Onikusa japonicum
KMGYWDPDYVVKETDVLALFRVSPQPGVDPIEASAAVAGESSTATWTVVWTDLLTACDLYRAKAYKVEAVPKTTDQFFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEVKGHYMNVTAATMEEMYERAEFAKQLGTVIIMIDLVIGYTAIQTMAIWARKNDMILHLHRAGNSTYSRQKNHGMNFRVICKWMRMAGVDHIHAGTVVGKLEGDPEMIRGFYNTLLLTHLDKNLIQGIFFEQDWASLRKVTPVASGGIHCGQMHQLLDYLGNDVVLQFGGGTIGHPDGIQAGATANRVALEAMVIARNEGRNYVAEGPQILRDAAKTCGPLQTALDLWKDITFNYTSTDTADFVETPTANV

SEQ ID NO: 7590 - protein, 501 aa, Hordeum vulgare subsp. vulgare
MMAMATAMAATYGAPIPAPAPSASSPRRAAPDGGRRLRAVAGRPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPENPNWFQGTADAVRQYLWLFEEHNVMEFLILAGDHLYRMDYQKFIQAHRETDADITVAALPMDEERATAFGLMKIDDEGRIVEFSEKPKGEKLKAMMVVTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSRVLDADVTDSVIGEGCVINHCKINHSVVGLRSCISEGAVIEDSLLMGADYYETENDKKVLSETGGIPIGIGKNTHIKKAIIDKNARIGENVKIINVDDIQEASRESDGYFIKSGIVTVIKDALIPSGTVI

SEQ ID NO: 7591 - protein, 111 aa, Actinobacillus actinomycetemcomitans
HLKYTHPALAIPELMRILIDEDRFRMQKAWDTTRRIFSYTCHTLMSEALETWPVEMMAKILPAHLQMIFEINDHSSICENLHHYRYDFIRRVSLVEEGDQRKVRMGWLSVV

SEQ ID NO: 7592 - protein, 295 aa, Zea mays
MAGLSLQHPWAFTFGLLGNVISFMTFLAPTPTFYRIYKSKSTEGFQSVPYVVALFSAMLWIFYALIKSNETFLITINAAGCVIETVYVVMYFVYATKKGRMFTAKIMLLLNVGAFGAILLLTLLLFKGDKRVVMLGWICVGFSVSVFVAPLSIMRRVIQTKSVEYMPFSLSLSLTLSAVVWFLYGLLIKDKYVALPNILGFTFGVVQMVLYVVYMNKTPLPVADGKAAGKLPSAADEHVVVNVTKLSPGRLPPVTQMAAVPTKSCATEAAAPATLPSRDVVDVLVNRHSPAVHVT

SEQ ID NO: 7593 - protein, 191 aa, Zea mays
  unsure (1)..(191): unsure at all Xaa locations
ITMDPTKFRPSSSHDTTVTTTNAGAPVWNDNXALTVGPRGPIPAGDYHLIEKVAHFARERIPXRVXHARGASAKVFFECTHDVTSLTCADFLRAPGVRDPRDRGLLDVIHXRGSPEKIPDPPGFPGNLTPRREIGPGGKKFPRFFIREGIKFPEXPAFKPNRGSNGKKWGGLKFLXHLPENGKLFFLLLRG

SEQ ID NO: 7594 - protein, 507 aa, Streptomyces avermitilis MA-4680
MTRFAAPGTDGAIVSYQARYDHFIGGEYVPPARGQYFENPSPVNGQPFTEIARGTAEDVERALDAAHAVAPAWGRTSVAERSDILRRIADRMEANLEKLAVAESWENGKPVRETLAADIPLAIDHFRYFAGAIRAQEGSLGEVDDDTVAYHFHEPLGVVAQIIPWNFPILMATWKLAPALAAGNAVVLKPAEQTPASIHYWLSLVADLLPPGVLNIVNGFGVEAGKPLASSPRVAKVAFTGETTTGRLIMQYASENITPVTLELGGKSPNIFFDDVWSANDDFRDKALEGFTMFALNQGEVCTCPSRALVQRGQYAEFMEAAVARTELIKTGHPLDTDTMIGAQASNDQLEKILSYLDIGRQEGAKILTGGERIEHDGELKGGYYVQPTIFEGDNRMRIFQEEIFGPVVSVTSFNDFDDAIKIANDTLYGLGAGVWTRDINTAYRAGRAIQAGRVWTNCYHAYPAHAAFGGYKGSGIGRETHKMMLDHYQQTKNLLVSYSPKKLGFF

SEQ ID NO: 7595 - protein, 476 aa, Campylobacter jejuni subsp. jejuni NCTC 11168
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAIEHLKNSGIADTAYFGPENEFFVFDSVKIVDTTHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 7596 - protein, 486 aa, Oligotropha carboxidovorans
MNDQSMTIRGKDRYKSGVMAYKKMGYWEPDYVPKDTDVIALFRVTPQDGVDPIEAAAAVAGESSTATWTVVWTDRLTAAEKYRAKCYRVDPVPNSPGQYFAYIAYDLDLFEPGSISNLTASIIGNVFGFKPLKGLRLEDMRLPVAYVKTFQGPATGIVVERERLDKFGRPLLGATVKPKLGLSGRNYGRVVYEALKGGLDFTKDDENINSQPFMHWRERFLYCMEAVNRAQAASGEVKGTYLNVTAATMEDMYERAEFAKELGSCIVMIDLVIGYTAIQSMAKWARKNDMILHLHRAGHSTYTRQKNHGVSFRVIAKWMRLAGVDHIHAGTVVGKLEGDPNTTRGYYDICREEFNPTKLEHGIFFDQNWASLNKMMPVASGGIHAGQMHQLLDLLGEDVVLQFGGGTIGHPMGIQAGAIANRVALEAMILARNEGRDYVAEGPEILAKAAATCTPLKSALEVWKDVTFNYESTDAPDFVPTAIAAV

SEQ ID NO: 7597 - protein, 128 aa, Zea mays
FFDKAIGINVPRSRFLPVKATSDLLLVQSDLYPLVDGFVIRNPSRANPANPSIELGPEFKKVANFLARFKSIPSIVELDSLKVSGDVWFGSGITLKGKVTIPPKSGVKLEVPDGAVFENKDVNGPEDL

SEQ ID NO: 7598 - protein, 196 aa, Desulfitobacterium hafniense
MSMQSGVFMDHLAALVGEGKVSVQAIDTAVRRILTVKARMGLFDNPYRSLNEAPPGPAPYLAAHDELAREAARRSVVMLKNDGDVLPLRKSGQRIALIGPFARDRANLAGCWNIFGDPSREVDLETGLRAALADGDALEVVEGCDFESAIDGGIDAAVAAARGADAVLLALGEPSGFSRGSAIGPPNCVCGRAPWA

SEQ ID NO: 7599 - protein, 375 aa, Helicobacter pylori J99
MTFEPYPFERLRALFKEITPKKKGLDLGIGEPRFETPKFIQDALKSHTHSLNIYPKSAFEESLREAQRGFFKRRFKIELKENELVSTLGSREVLFNFPSFVLFDYPNPTIAYPNPFYQIYEGSAQFARAKSLLMPLVKENDFTPSLNEKELQEVDLVILNSPNNPTGRTLSLEELIAWVKLALKHDFILINDECYSEIYENTPPSSLLEACMLADNGAFKNVLVIHSLSKRSSAPGLRSGFIAGDSSLLEKYKAFRTYLGYTSANAIQKASEVAWLDDRHAEFFRNIYANNLKLARKIFKETLIYPYSFYAYLPVKDGENFAKTLYQNEGITTLPALYLGRNHIGADYVRLALVYDTSLLEKPLEIIEAYRENYA

SEQ ID NO: 7600 - protein, 534 aa, Brucella melitensis 16M
MVIGRDGISYLYIAPGERRIARLREHLKAAPQLRERIRICTPSVLKSILRQRHQRDLVMRAHAMTPQLFSAARVLDTPQAFVIAMAVYAFLGCIVNWPMKTMLALHVAMSLFFFGCVLIRLFAAASGKRLQFTEIAPFKPRDLPVYSILVPLYREKDVVAQLIAALNRLNWPRSKLDIKLVCEKDDYETIAAIRCNTMPSNFELVLVPPGGPRTKPKALNYALQFARGEIVAVFDAEDRPHPDQLLEAWQAFRRGGSKLACVQAPLIIGNFRRNLLTRMFAFEYAVLFRGLLPWLARRGLVIPLGGTSNHFRRSCLEQVGGWDAYNVTEDADLGMRLARFGYRIDVISRGTIEDAPEEHGVWHRQRTRWIKGWMQTWLVHGRQPMNTWRELGWWRFVVSQIYTLGIIGSALLHPLMLLMLAGLCLRMAFGPLTPQGLWLLALDVINILMAYMSFHMLGAKTMEPTELGGYAYFLAIPIYWVLISLSAWRAVWQLVRQPHLWEKTPHQPNLFYIPLEDASSEFDARNAAPRPIMD

SEQ ID NO: 7601 - protein, 170 aa, Fusobacterium nucleatum subsp. nucleatum ATCC 25586
MDLKNYVASIENYPKEGIIFRDITPLMNDGEAYKYATEKIVEFAKDHHIDIVVGPEARGFIFGCPVSYALGVGFVPVRKPGKLPREVIEYAYDLEYGSNKLCLHKDSIKPGQKVLVVDDLLATGGTVEATIKLVEELGGVVAGLAFLIELVDLKGRERLDKYPMITLMQY

SEQ ID NO: 7602 - protein, 386 aa, Dechloromonas sp. RCB
MYRPARRLADIEPFHVVELLTRARQLEAEGRDIIHMEVGEPDFPTPEPIANSAINAIKSGKTLYTQALGLPELREAISQFYGQRYGASVPASRIAVTNGASGALNLAFACLADPGSEWLLTDPGYPCNRHILRAYEGCPQNIPVGPDTNFQPTPELLRRHWKSTTAGLLVASPANPTGTLLTLPEIAGLSEVCREKNGHFLVDEIYHGLTYEIDAPTACAAGEDIWVINSFSKYFQMTGWRLGWMVIPEAYVRDVEKLAQNLTLCPSTPAQHAALAAFEPETIAILESRRSEFRRRRDFLAPALEAIGFRITARPEGAFYLYCDCSALADDSFALAKDLLEKTGVAATPGLDFGSNQPEKHIRFAYTTGVERLAEAVERLSRYFGR

SEQ ID NO: 7603 - protein, 110 aa, Quercus suber
SLDIWDPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKAN

SEQ ID NO: 7604 - protein, 500 aa, Citrus sinensis
LLLIPLLLILKKLKAQNKQQLPPSPPKLPVIGNFHQLGELPHQSLWQLSKKYGPVMLLKLGRVPLVVISSAEAARDVLKVHDLDCCSRPPLIGSGKFTYNYSDIAFSPYSDYWRELRKISVLEVFSLRRVQSFGFIREEEVALLMNSISESSSSASPVDLSEKMFALTGSIVFRMAFGRRFRGSNFDNHSFQELVHAVESLLGGFAAAECFPYVGWIIDRLNGYHAKLERVFQELDTLFQQIIDDHLKPAETTKQEHVQQDIIDVMLKIERDQAESHESEAWLTKNHIKAVLLNIFLGGVDTSAITVIWAMAELCKNPRLMKKAQAEIRNHIGNKGRVTEADIDQLQYLKMVIKETLRLHPPAPLLIARDTLYRFKVNGYDIYPKTLIQVNAWAIGRDSKYWESPEEFIPERFIDKPVDVKGQDFEYLPFGSGRRICPGINLGLIMSELALANLLYCFDWKLPNGREEDCVNMNMEEATGVSLTLSKKTPLILVPVNYLQ

SEQ ID NO: 7605 - protein, 339 aa, Saccharomyces castellii
MVGPKTKKQKVANAGGSTSLDLLKKTGTTVVADTGDFATIDKYKPQDATTNPSLILAASKKEDYSSLVDNAVAYGKENGETIDEQVECAIDKLLVEFGTEILKIVPGKVSTEVDARLSFDKDATIKKALQLIHLYEKAGISKDRVYIKVASTWEGIQAAKVLEQEHGITTNLTLLFSFTQAVACAEAGVSLISPFVARITDYYKAQTGKDYSPEDDPGIHSVKKIYNYYKKHGYHTIIMAASLRTTGQVKQLAGIDNLTLSPKVLDELVASTDEVPKLLDPKKAAKQGDEKISFLDDEPKFRYSLNDDAMATEKLADGIRKFAADAITLSNAIKEKLQK

SEQ ID NO: 7606 - protein, 122 aa, Glycine max
PFLMECCERTENDKKGGHLAERIADGRLILRESAQCADEDEKEFQNITKHRYFNTNNLWIRLDKLQEELKQQGGVIRLPMIKNSKTVDPKDSSSTPVFQLETAMGAAIECFDGAGAVCVPRT

SEQ ID NO: 7607 - protein, 535 aa, Oryza sativa; identical to SEQ ID NO: 5298

SEQ ID NO: 7608 - protein, 539 aa, Glycine max
MASSLRISRLLSRSFLSASTTTPLFSRGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDELAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLFHEAGLPAGVLNVISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 7609 - protein, 321 aa, Brassica rapa
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 7610 - protein, 468 aa, Chorda filum
IPYAKMGYWDADYNVKDTDILALFRITPQPGVDPVETAAAVAGEPSTATWTVVWTDLLTACDIYRAKAYRVDPVPGTSDQYFAYIAYECDLFEEGSLANLTASIIGNVFGFKAVKALRLEDMRIPYAYLKTLQGPATGVIVERERLDKFGRPSLGATVKPKLGLSGKNYGRVVYEGLCGGLDFLKDDENINSQPFMRWKDRFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAASTCGPLKAALDLWKDITFDYTSTDTPDFVEQATESK

SEQ ID NO: 7611 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 7612 - protein, 334 aa, Pseudomonas syringae pv. tomato str. DC3000
MSHDAHQPAQRVMVLYTGGTIGMQASANGLAPASGFEARMAGQLADHPELRVPQWRFREMSPLIDSANMTPAYWLRLREAVIEAVDVEGCDAVLVLHGTDTLAYSAAAMCFQLLGFSAPVVFTGSMLPAGVQDSDAWENVNGALLALGSGLVSGVQLYFHGQLMTPVRCAKIRSFGRQPFAPLQRSRGGHAVVSLPDALDYRRTKAQARVAVLPLFPGVGAAQLDGLVNSRIQGLVLECFGSGTGPSDDPQFLASLENARAQGVCVVAITQCHEGGVELDVYEAGSRLRGAGVLSGGGMTREAALGKLHALLGAGLTTEEVRRLVELDLCGELR

SEQ ID NO: 7613 - protein, 361 aa, GIBBERELLA ZEAE PH-1
MSVQIPSQQRAAVRQGSGPDARAPIKTVPVPSPGPGQILVKVNWTGLCGSDKSLLHDEWSDFGICMKDVTNGIAGHEGAGSVVAVGQGMEQRWKIGDRAGVKWIASVCGECDFCMVGSDEVHCPEQTNSGFSVPGTFQEYVVADGKYSSKLPDGVTDEEAGPIMCGGVTAYTACKRSGVTPGQWLVIPGAGGGLGHFAIQYAKAMGMRVIAIDGGDEKRDLCLKLGAEVFIDFKTTKDIATQVLKVTTHGAHGVIVTAATRAAYESAPNYLRPNGTVVAVGLPQDPTVLAGAPPMLVALRRLKIVGSVTGSMKDVEEALEFTARGLVHPILSKGKLEDLDDWVHKLATGQVAGRCVLKVAA

SEQ ID NO: 7614 - protein, 446 aa, Zea mays
MSSRSGSTGGGSTGGGSSAGGGGAVPLAVLLRREVASERTASERPELHWGLFSQAKKGEDFTFLKPECERVPDVPSSSFSAFGLFDGHNGNGAAIYTKENLLNNILSAVPADLNREDWLAALPRALVAAFVKTDKDFQTKARSSGTTVTFVIIDGLVITVASVGDSRCVLQAEGSIYHLSSDHRFDASKEEVDRVTECGGDVGRLNVVGGAEIGPLRCWPGGLCLSRSIGDQDVGEFIVPVPLVKQVKLSTAGGRLIIASDGVWDVLSPEVAFNCSRELPPVPAAEQIVKTAVQSKGLRDDTTCIVVDIIVEKNNSSMPLAKRQPGIGVFKNMFGKKKSSDSSSHSHSDREYMDPDNVEEIFEDGCALLSRRLDSEYPVRNMFKLFICAICQVELKPNQGISVHEDSSQPGSLRRWDGPFLCQSCQEKKEAMEGKRRSRDSSRNSG

SEQ ID NO: 7615 - protein, 249 aa, Petunia x hybrida
MSRRYDSRTTIFSPEGRLYQVEYAMEAIGNAGSAIGISSKDGVVLVGEKKVTSKLLQTSTSSEKMYKIDDHVACAVAGIMSDANILINTARVQAQRYTFSYQEPMPVEQLVQSLCDTKQGYTQYGGLPPFGVSFLFAGWDKNFGFQLFMSDPSGNYAGWKAAAIGANNQAAQSMLKQDYKDDITREEAVQLALKVLSKTMDSTSLTSEKLELAEVFLSNGKVKYQACSPEKLNSMLVKSGLTQPSAEES

SEQ ID NO: 7616 - protein, 239 aa, Phytolacca americana
  unsure (1)..(239): unsure at all Xaa locations
VQLRRMENKINRQVTFSKRRSGLVKKAHEISVLCDAELALIIFSPRGKLFEYSTDSSMEKILERYERYFYAERQLASNDPNTEVNWTFDFAKLKAKLELLQRNHRHYLGQDLDSLNIKDLQSLEQQLDNALKHIRTRKNQLMHESISELHKKEKAMQEQNNMLVKKIKEREKAMAEAQGMQWQRQQNEPPEASNFLLPPPLTSWNTAGDAYHGQIAGEVKRNDLDLTLEPVYSCXXGCF

SEQ ID NO: 7617 - protein, 764 aa, Sinorhizobium meliloti
MPGIDKTDRAMTSVTAQEALDFHSQGRPGKLEISPTKPMATQRDLSLAYSPGVAVPVKAIADDPATAYDYTARGNMVAVISNGTAILGLGNLGALASKPVMEGKAVLFKRFADVDSIDLEVDTENVDEFVNCVRFLGPSFGGINLEDIKAPDCFIIEQRLREVMDIPVFHDDQHGTAIIAAAGLVNALTLTGRDFKTAKLVCNGAGAAAIACIELIKAMGFNPENIIFCDTKGVIYKGRTDGMNQWKSAHAVETDRRTLAEALDGADVFFGLSAKGALSADMVRSMGARPIIFAMANPDPEITPEEVALIRDDAIVATGRSDYPNQVNNVLGFPYIFRGALDVRASTINDAMKIAAAEALANLAKEDVPDDVAAAYQGNRPRFGPQYIIPVPFDPRLISAIPMAVAKAAMETGVARKPIEDLKAYGQQLSARRDPIASTLQRIVERVRRQPKRIVFAEGEEVQMMRSAIAYANQQLGTALLLGREEVMRETAEREGIDLDRAGIQIVNARLSKRVGAYTDFLYSRLQRKGYLFRDVQRLINTDRNHFAASMVALGDADGMVTGLTRNYSTALEDVRRCIDPKPGHRVIGVSIALCRGRTVLVADTAVHKHADLRGAGAMLAYSTFGHPSGERSERVREAVKILDRRRVDFEYDGEMAADVALNARVMEQYPFCRLSGTANVLVMPAFHSASISTKMLQELGGSTVIGPLLVGLDKSVQIASMSAKDSDLVNLAAIAAYNAGTRRGSAESRKTAGTSSVAASPDG

SEQ ID NO: 7618 - protein, 466 aa, Onikusa foliacea
YAKMGYWDPDYAVKETDVLALFRVTPQPGVDPVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGDDVVLQFGGGTIGHPDGIQAGATANRVALEAMVIARNEGRDFVAEGPQILRDAAKTCGPLQTALDLWKDISFNYTSTDTADFVETPTANV

SEQ ID NO: 7619 - protein, 161 aa, Triticum aestivum
MAKNTCKLCFRRFASPRALAGHMRSHSVRNLAAKQQISSASSASASFTAAADDDVSFKKPLPIYALRENPKRSLRVTDVAFSDRESEAESTPAHPKRAHAVAAGAETEPLSSVSDAATPEEDVALSLMMLSRDSWASMGRGDSDGDYFDDRSDWGYTAPAS

SEQ ID NO: 7620 - protein, 570 aa, Brassica rapa subsp. pekinensis
MVASPDCRISLSAPSCLRGSSGYTKHIKLGSFCNGELMGKKLNLAQLRSSSTNSSQKRIQMSLNSVAGESKVQEIESEKRDPKTVASIILGGGAGTRLFPLTKRRAKPAVPIGGAYRLIDVPMSNCINSGINKVYILTQYNSASLNRHLTRAYNSNGVFGDGFVEALAATQTPGETGKRWFQGTADAVRQFHWLFEDARSKEIEDVLILSGDHLYRMDYMDFVQDQSTKRRDISISCIPIDDRECKRVQQIHSKIMVSYKSLSVLHGRRASDFGLMKIDDKGRVISFSEKPKGDDLKAMAVDTTVLGLSKEEAEKKPYIASMGVYVFKKEILLNLLRWRFPTANDFGSEIIPFSAKEFYVNAYLFNDYWEDIGTIRSFFDANLALTEHPPAFSFYDAAKPIYTSRRNLPPSKIDGSKLIDSIISHGSFLTNCLIEHSIVGIRSRVGSNVQLKDTVMLGADFYETEAEVAALLAEEKVPIGIGENTKISSKTKRSLSNGLPSKQKVLDSFFPSHFPYRECIIDKNARVGKNVVIANSEGVQEADRSSDGFYIRSGITVILKNSVIADGVVI

SEQ ID NO: 7621 - protein, 517 aa, Zea mays; identical to SEQ ID NO: 5670

SEQ ID NO: 7622 - protein, 550 aa, Zea mays
  unsure (1)..(550): unsure at all Xaa locations
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAXARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 7623 - protein, 203 aa, Cytophaga hutchinsonii
MKPPLVIGICGGSASGKTYLKDVLIENSPAGKVQEFTLDSYYLPREWQKADANGYLNFDLPEAFNTQKMIYDFMDLSSGFSIEQPIYKYKNVPLSIDFKIVEPAPVIIAEGIFLFYYKEMRERIDKKIFIDAPFEVKRQRRIERDVRERGYEVPEIHYRFDNHAQESYNTYVLPYVQEVDYVIENQQMLDSAIPALLKQIKDY

SEQ ID NO: 7624 - protein, 487 aa, Rhizobium sp. NGR234
MQRFQCYIDGEFADGEGRFESVDPATGAAWAEMPEAREADVDRAVEAAHKALDAGPWSKLTATLRGKLLYRLADLVAENAQRLAELETRDTGKIIRETSAQIAYVAEYYRYYAGIADKIEGSYLPIDKPDMEVWLRREPIGVVAMVVPWNSQLFLSAVKIGPALAAGCTMVVKASEDGPAPLLQFARLVHEAGFPAGVVNIITGFGPACGAALSRHPKVDHIAFTGGPETARHVVRNSAENLASTSLELGGKSPFIVFADADLESAANAQVAGIFAATGQSCVAGSRLIVEKSVKDRFLEILKRKAEAICIGSPLDMATEVGPLATERQRAHIQALLGRSLAAGARLVTGGTAPDGAGFFYQPTILDCDGNSTPALEEEFFGPVLSVVSFETEAEALALANATRYGLAAGLFTRDLTRAHRLMKGIRTGIVWVNTYRAVSPIAPFGGFGLSGHGREGGMEAALDFTRTKTVWLRTSDDPIPDPFVMR

SEQ ID NO: 7625 - protein, 433 aa, Pseudomonas fluorescens PfO-1
MFTTMAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRG

SEQ ID NO: 7626 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 7627 - protein, 216 aa, Triticum aestivum
  unsure (1)..(216): unsure at all Xaa locations
MSSMQFSSVLPLEGKACVSPVRREGSACERLKVGDSSSIRHERASRRMCNGGRGPAATGAQCVLTSDASPADTLVLRTSFRRNYADPNEVAAVILGGGTGTQLFPLTSTRATPXAVPMGGCYRLIDFSMSNCFNSGGNKIFVMTQFNSASXDRHIHRTYLGGGINFTDGSVEVLAATQMPGEAAGWFRGTADAVRKFIWVLEVRRVLSGYLYICMC

SEQ ID NO: 7628 - protein, 153 aa, Lilium longiflorum
LKPLKSMDSKFEVDHSLIAKLNQLTEFLANRNQPLRAPFVPDARAMPAAATDIKDMPGAYVFIIDMPGVESEEIKIDVEEGNMLVISGERKREEEEERYLEMQRRMGKMMRKFKLLENANSGAISAVCKNGVLTVTVEKLPSQEPKAIEIKIA

SEQ ID NO: 7629 - protein, 1082 aa, Oryza sativa
  unsure (1)..(1082): unsure at all Xaa locations
MVDTRRSAAAKRRASSVEAASPATDGAAAGAGAAGSSTPRRRSGKRAKAEATVGTPAAKAGGADATAAAAIDVIDSSVENLHGVARPTGAVPASSTVSNSGVKKRPTKYINVPSAEELSLWKARQAVANGRAEAWGRLISQSSESPSVPIYTTHFTVGHGGNYDLRLTESFPGSLICKLKHVKRGAALEIYVSKAVHVNGKVLDKTAKVTLVGGDEVIFSSLGRHAYIFQQLPEERSSTSTFSATCAFQQGQYPVTKGTLDVSSKGAKLSVMPFNFGNGRPPLVPHDTEIVSSLCKTMEEQSQLASEENLQVAQHQLLKEDLKKVVVNASDISDSFDSFPYYLSENTKNALLSSAYVNLCCKESIKWTKHISSLCQRVLLSGPAGSEIYQESLVKALTKHFGAKLLIIDPSLLASGQFSKSKESESYKKGDRVRYIGSVQSTGIILEGQRAPDYGSQGEVRLPFEENESSKVGVRFDKKIPGGIDLGGNCEVDRGFFCPVDSLCLDGPGWEDRAKHPFDVIYEFASEESQHGPLILFLKDVEKMCGNSYSYHGLKNKIESFPAGVFIVGSQIHTDSRKDKSNSGSPFLSKFPYSQAILDLTFQDSFGRVNDKNKEALKIAKHLTKLFPNKVTIQTPQDELELSQWKQLLDRDVEILKAKANTSKIQSFLTRNGLECADIETSACVKDRILTNECVDKVVGYALSHQFKHSTIPTRENDGLLALSGESLKHGVELLDSMQSDPKKKSTKKSLKDVTTENEFEKRLLGDVIPPDEIGVTFEDIGALENVKETLKELVMLPLQRPELFSKGQLMKPCKGILLFGPPGTGKTMLAKAVATEAGANFINISMSSIASKWFGEGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKNLCVTAAHCPIREILEREKKERASAEAXENKPLPPPRSSSDVRSLRMNDFKHAHEQVCASITSDSRNMTELIQWNDLYGEGGSRKKTSLSYFM

SEQ ID NO: 7630 - protein, 189 aa, Yersinia mollaretii
GSSIGGWKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYK

SEQ ID NO: 7631 - protein, 484 aa, Oenococcus oeni MCW
MALKQYQMYINGEWVDSDNGEKITVYNPSNEEAISQVPSASLKQVKEAIDDAYAAQKDWKRVPAATRGSYLVRIAALIRKNADYLARTLSEEEGKILSLAMTEVTFSADYIDYMAAQGRTYEGEVIQSDNANENIALLKQPIGVAAGILPWNFPFFLITRKFAPALVTGNTIVIKPSSDTPNIALEFAKLANQVGLPKGVLNFVTGPGSVVGSELSKNEKIGIISLTGSVDSRKRVMADASNHVAKVSLELGGKAPAIVCKDADIDLAVDSIINSRIDNNGELCNNCERVYVQEDIAEEFTKKLVAKMAATTIGDPIEHENIGMGPLINKAAVEKVDAMVQRAVKAGAKVECGGKRPEGKGYFYPATVVTNVKQSDELVQEEIFGPVLPILTFKKLDQAIDMANDSKLGLTSSIFTENMDAAATAANELEDGETYINRFNFEAMQGFHAGWKESGLGGADGKHGLEEYVNTHVVYLQRHPEKAD

SEQ ID NO: 7632 - protein, 486 aa, Ralstonia eutropha
MNAPETIQAKPRKRYDAGVMKYKEMGYWDGDYVPKDTDVLALFRITPQDGVDPVEAAAAVAGESSTATWTVVWTDRLTACDMYRAKAYRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKGGLDFMKDDENINSQPFMHWRDRFLFVMDAVNKASAATGEVKGSYLNVTAGTMEEMYRRAEFAKSLGSVIIMVDLIVGWTCIQSMSNWCRQNDMILHLHRAGHGTYTRQKNHGVSFRVIAKWLRLAGVDHMHTGTAVGKLEGDPLTVQGYYNVCRDAYTQTDLTRGLFFDQDWASLRKVMPVASGGIHAGQMHQLIHLFGDDVVLQFGGGTIGHPQGIQAGATANRVALEAMVLARNEGRDILNEGPEILRDAARWCAPLRAALDTWGDITFNYTPTDTSDFVPTASVA

SEQ ID NO: 7633 - protein, 183 aa, Gibberella moniliformis
IPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALSHDYLSPYHDPTDEPVAEEKFDWSFNDADLP

SEQ ID NO: 7634 - protein, 266 aa, Oryza sativa
  unsure (1)..(266): unsure at all Xaa locations
RVNGKLRCRCHVAARPLRRRPTPSTRTRTRTWSRRRSRGRTRRPAARPKARYKDDFRDSGGLEQQSVQELENYAAYKAEETTDALGGCLRIAENIREDAANTLVTLNKQGQQISRTHEKAVEIDQDLSXGESLLGSLGGFFSKPWKPKKTRQIKGPAHVSDDSFKKKASHIEQREKLGLSPXGKSANRSYAEPTTAMEKVQVEKQKQDDALDDLSGVLGQLKGMACDMGSELDRQNKALDDLQGDVDELNSRVKGANQRARKLIEK

SEQ ID NO: 7635 - protein, 488 aa, Salmonella typhimurium LT2
MKKINHWINGKNVAGNDYFQTTNPATGDVLAEVASGGEAEVNQAVAAAKEAFPKWANLPMKERARLMRRLGDLIDQHVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 7636 - protein, 365 aa, Xylella fastidiosa 9a5c
MNTQTPTVLDLVRQELRNFAGYSSARSVALTGDLWLNANESAWPNPADSHATMRRYPEPQPPKLRQMLAALYGCVPEQLLIGRGSDEGIDLLVRAVCEPGCDPVLVTPPVFGMYAVSAQLQNAPVIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAILRRCQAPYPLPTPCVSLAEQGLSAAALQVTAQRVAEIRAERERLGAALACLSGVRRVYPSQGNFLLVRFDDAEAALQALYAAGVVVRDQRAAPQLHDALRLTVGTPEQNTRLLAVLRDIQAVPA

SEQ ID NO: 7637 - protein, 488 aa, Oryza sativa
  unsure (1)..(488): unsure at all Xaa locations
MMFFYWSISETILSSFILRLAPHPPFILLFSSPSPHCSPPRRRRRRRRRRRSRDREMAAASSFTAAAKFLAPVSARSAGDYKPPLPLPASASLRPGRKPAPRLRTALAVSSDVLPGNKAAPAAAAHSVRTKSHIXVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 7638 - protein, 449 aa, Oryza sativa
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 7639 - protein, 405 aa, Arabidopsis thaliana
MPLSLQSPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIKSAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLASSMGPASVELLSAGVEGYANQAKRVEELFGKIWPPPNV

SEQ ID NO: 7640 - protein, 96 aa, Zea mays
LGVSLAVCKAGAAEKGVPLYRHIADLAGNPDLILPVPAFNVINGGSHAGNKLAMQEFMILPVGASSFKEAMRIGAEVYHHLKGVIKAKYGKDATMW

SEQ ID NO: 7641 - protein, 171 aa, Oryza sativa
  unsure (1)..(171): unsure at all Xaa locations
MGGSKDEQQDRGLFSNLMHGVAGGGGGHGYPYPPQQGYYPPPPXTAYPPPPPAGYGGGYGYPPAGYPGSSAPFQHGNHGGGNMGMLAAGAAAAAAAYGAHKLSHGHGHGGYGYGGHHGGLFGGHHGHHGGLFGGHHGHHGGGLFGGHHGHHGGLFGGHHGFGGHHGHHGHH

SEQ ID NO: 7642 - protein, 110 aa, Zea mays
  unsure (1)..(110): unsure at all Xaa locations
MPALGTPTSLAATMGNPEKLLNQIFNLKFTYKSLHRQARKCKKEEMEHKLTVKKAIVKGTMVGARIYTENAIRKLTXLMNYFRLDSGLDAVVARLDTQAMMQVMGKIMQS

SEQ ID NO: 7643 - protein, 248 aa, Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVQAPEGMAWEAAGHGPNNIQQTRLPSHSEAFFHPLEGNNSSSQIGYTHMGSDNEMNVGNPGQYVNGYIPGWML

SEQ ID NO: 7644 - protein, 473 aa, Triticum aestivum
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 7645 - protein, 518 aa, Mycobacterium tuberculosis H37Rv
MPAPSAEVFDRLRNLAAIKDVAARPTRTIDEVFTGKPLTTIPVGTAADVEAAFAEARAAQTDWAKRPVIERAAVIRRYRDLVIENREFLMDLLQAEAGKARWAAQEEIVDLIANANYYARVCVDLLKPRKAQPLLPGIGKTTVCYQPKGVVGVISPWNYPMTLTVSDSVPALVAGNAVVLKPDSQTPYCALACAELLYRAGLPRALYAIVPGPGSVVGTAITDNCDYLMFTGSSATGSRLAEHAGRRLIGFSAELGGKNPMIVARGANLDKVAKAATRACFSNAGQLCISIERIYVEKDIAEEFTRKFGDAVRNMKLGTAYDFSVDMGSLISEAQLKTVSGHVDDATAKGAKVIAGGKARPDIGPLFYEPTVLTNVAPEMECAANETFGPVVSIYPVADVDEAVEKANDTDYGLNASVWAGSTAEGQRIAARLRSGTVNVDEGYAFAWGSLSAPMGGMGLSGVGRRHGPEGLLKYTESQTIATARVFNLDPPFGIPATVWQKSLLPIVRTVMKLPGRR

SEQ ID NO: 7646 - protein, 200 aa, Zea mays
  unsure (1)..(200): unsure at all Xaa locations
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRXPRKLPGEVISEKYVLEYGTDCLEMRVGAIERSGERVLVIDDLVATGGTLCAAIRLLERAGADVVECACVIGLPKFKVSE

SEQ ID NO: 7647 - protein, 294 aa, Leptospira interrogans serovar lai str. 56601
MKSRKGIILAGGSGTRLYPVTYVVSKQLLPVYDKPMIYYPLTTLMLAGIKEILLISTPQATPMYKELLGDGKQWGISIEYAVQPNPGGLAQAYWIGENFVNGHPSVLILGDNIYFGHNLASLLENASKKENGSTVFAYPVHDPERYGVVEFDSERRAVSIEEKPSKPKSNYAVTGLYFYDEEVVNIAKSIKPSARGELEITDVNRIYLERGILNVQVMGRGYAWLDTGTHESLLEASVFIETIEKRQGLKVACPEEIAFRKGFIDGSQLEKLISPLKKTGYGEYLVKVLNEKIY

SEQ ID NO: 7648 - protein, 1224 aa, Glycine max
MVSTRRSGSLSAKRSSSSEDKSPSPKRQKVDNGGSSEKSVPTPAENSKDLSSPEPVPDPGECGSGDAQIAGAGAADGVSSGKGDATPAVPVTAPIADAACPSFSSWINYQKQNPNIEGAPWCRFLSQSAQNPNVAVCTPIFTIGSNRSCNFPLNDQTISGNLCKIKHTQGDGSAVAVLESMGSKGSVLVNGTHVKKNTSCVLNSGDEVVFGVLGNHSYIFQQLNTEVAVRGAEVQSGIGKFLPLERRSGDPSAVDGASILASLSNRQDLTRWKSPSQTSSKPHQGTDVSSRSVHHDCTETELDGSESTPNVRSDKAAEVRTSDKNSTMDCNPDAGAEAGNVKISGVNDFLRPFFRILAQPSCKLKLSRSICKQVLEERNGTLDMQAASTLGTSVRCAVFKADVHAAILDGKEIDASFDNFPYYLSENTKNVLVAACFMHLRHKEHEKFTADLTTINPRILLSGPAGSEIYQEMLVKALAKYFGAKLLIFDSHLLLVGLSSKEAELLKDGLNAEKSFGCTKLSPTEDMARIMDPLASEIETPSPSNAPTSYGFESQPKLETDNMPSTSGTAKSCSFKLGDRVKFSCSSSCGVYQTSPRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKERAAALAEGQPAPALCSSGDVRSLNMEDFKYAHQQVCASVSSESVNMTELLQWNELYGEGGSRVKKALSYFM

SEQ ID NO: 7649 - protein, 110 aa, Triticum aestivum
  unsure (1)..(110): unsure at all Xaa locations
AMGIALLRMMPNRPLLSCFAYAFPFAVSSPIGVAVGIAIHPTTQGAVADWMFRXSPMGLATGIFXXCSVSHLLSKGYKPQRPVAADTPLGRWLAVVLGVGVIPVVMIWDT

SEQ ID NO: 7650 - protein, 299 aa, Oryza sativa (japonica cultivar-group)
MAAEAAPEWVEKGDNAWPLAAATLVGLQSVPRLVILYGDCGAVGPRTEKDREAFPPNNVLLTLAGAGLLLWMGWTGFNGGAPYAANVDASVTVVNTHLCTATSLLVWLLLDSFVFGRLSVISAVQGMITGLVCVTPAARLVLHKRSRLLARVDDTLAVLHTHGVAGSLSGVLTGLLLLAEPRFARLFFGDDPRYVGLAYAVRDGRAGSGLRQVGVQLAGIAFVVALNVAVTSAVCLAVRVAVPQLAGGGDAIHGEDAYAVWGDGETYEQYSVHGGGSNHGGFPMTANPVASKADEMIWI

SEQ ID NO: 7651 - protein, 488 aa, Hydroclathrus clathratus
MPEDVQNRTRIKSERYESGVIPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIIMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAASCGPLKAALDLWKDITFDYTSTDTPDFVEVATGSR

SEQ ID NO: 7652 - protein, 164 aa, Zea mays; identical to SEQ ID NO: 4781

SEQ ID NO: 7653 - protein, 522 aa, Malus x domestica
MSIITGSAATGSFSSGNTGGEEVQQQQQELLNHHANFHGSNSLLPTTPNINSNGISTTQVQKQPPPAKKKRNLPGTPDPTAEVIALSPKTLMATNRFVCEICKKGFQRDQNLQLHRRGHNLPWKLKQRTSTEIIKRVYICPESSCVHHDPSRALGDLTGIKKHFFRKHGEKTWKCDKCSKKYAVQSDWKAHLKTCGTREYKCDCGTIFSRRDSFITHRAFCDAIAEENNRNQGVVPMSNNIMGAPNQGQLSNSELIIPASPPMNNKITDNPSSARSDTTTSDQFHHNFDAKNAPLTLEPQQPFPMPTKPVNMLPRTLSNNTSSSTSPSSLLFGLNHGGHDQSLIPNSSGHLSATQLLQKAAQMGATMSGGPNPNPSGTTITSMAPSTYGTATGGYNMNPFMQQRDPNNILQLETSPQFFGANYAQMGMFSGMLFDHAQNNGLLKNMEHENNGTSNKIGFRGASNVGNGDTLTVDFLGLGGSGNNNRPENFHDLQKQQHGQQDQLGFGGIDDHDDHLRMQRFG

SEQ ID NO: 7654 - protein, 550 aa, SYNECHOCOCCUS SP. WH 8102
MSRMLRGLRIWRAVLTFLLFLWWDSQAWTYRGGPTPERRAARQQRRARWLTAELLQLGSAFIKFGQLLSARPDILPAGWVAELASLQDSVPAFPFEQVQTVLEEELGPRCAEVIDLDPVPLGAASLAQVHRASLRSGRQVVLKIQRPGLDTLFRLDLEVMQQVAAVLQRHPSWGRGRDWPAMARECRRVLLRELDFRVEAQYAARFRQQFLDDERIRIPAVIWEQSTRRVLCLDYLPGIKVNDREALVEAGVDPSAVAEIGAASYLKQLVRFGFFHADPHPGNLAVASDGALIYYDFGMMGLLSDGLRRRLGSMVRAAAARDSAALVDEMQAAGVISKEIDVGPVRRLVRLMLNEALTPPFSSNVIDKLSGDLYDLVYGQPFRLPVELIFVMRALSTFEGVGRSLDPAFSLVGIAKPYLLPLMTSSGSGSNDLFNELGRQVGALSSRAAALPRRLDESLERLEQGDLQLQVRLGESDRQFRRMTLAQQSIGQSVLLGCLALSAAIVGASVRPLWALLPAAAAVPVGMGWFQMQVRMRRDQRLEQLPGSNR

SEQ ID NO: 7655 - protein, 371 aa, GIBBERELLA ZEAE PH-1
MSPSFHSLLAIATLAGSAALASPIPEPETPQLIPRAVGDFECFNASLPNITIFATGGTIAGSAGSADQTTGYQAGALGIQALIDAVPQLCNVSNVRGVQIANVDSGDVNSTILTTLAHRIQTDLDNPHIQGVVVTHGTDTLEESSFFLDLTVQSEKPVVMVGSMRPATAISADGPINLLSAVRLAGSKSAKGRGTMIVLNDKIASARYTVKSHANAVQTFIAEDQGYLGAFENIQPVFWYPASRPLGHHYFNISASSPKKALPQVDVLYGHQEADPELFQAAVDSGAQGIVLAGLGAGGWPDEAADEIKKVLNETNIPVVVSRRTAWGYVGERPFGIGAGYLNPSKARIQLQLALEKKLSVEEIQDIFEYV

SEQ ID NO: 7656 - protein, 96 aa, Ginkgo biloba
LDMPGLKSNDIKVQVENENVLNITGERRRDEKADADAKYIRMERRVGKFMRQFTLPSDANLEGISATCYDGVLTVTVPKIPPPEPKKPKTIEVIAS

SEQ ID NO: 7657 - protein, 354 aa, Pseudomonas aeruginosa PAO1
MALISMRQMLDHAAEFGYGVPAFNVNNLEQMRAIMEAADKTDSPVIVQASAGARKYAGAPFLRHLILAAIEEFPHIPVVMHQDHGTSPDVCQRSIQLGFSSVMMDGSLREDGKTPADYDYNVRVTQQTVAFAHACGVSVEGELGCLGSLETGMAGEEDGVGAEGVLDHSQLLTDPEEAADFVKKTKVDALAIAIGTSHGAYKFTKPPTGDTLSIQRIKEIHARIPDTHLVMHGSSSVPQDWLAIINEYGGEIKETYGVPVEEIVEGIKYGVRKVNIDTDLRLASTGAIRRFLAQNPSEFDPRKYFSKTVEAMRDICIARYEAFGTAGNASKIKPISLEGMFQRYARGELDPKVN

SEQ ID NO: 7658 - protein, 366 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCG

SEQ ID NO: 7659 - protein, 857 aa, Glycine max
  unsure (1)..(857): unsure at all Xaa locations
SAAYRGIVVRRPGLAEAIGERRAKAERMFSLMDGFLKNDPLTLQKDILEPVEYTVARSRFSFDDFEAYQALSHSVRDRLIERWHDTHVYVKRTKPKRLYFLSLEFLMGRSLSNSVINLGIQDQYAEALSQLGFEFEVVAEQEGDAALGNGGLARLSACQMDSLATLDYPAWGYGLRYEYGLFRQIIVDGFQHEQPDYWLNYGNPWEIERIHVTYEVKFYGTVEEVEMNGEKHQVWVPGETVEAVAYDNPIPGYGTRNTINLRLWAAKPSNKFDLEAYNTGDYINSVVNRQRAETISNVLYPDDRNHQGKELRLKQQYFFVSASLQDIIRRFKEAHNNFDELPDKVALHLNDTHPSLSIAEIMRILVDEEHLVWNKAWDIACKVFSFTTHTVVAEGLEKIPXVDLLGSLLPRHLQILYEINFKFMEELKKKIGLDYNRLSRMSIVEEGAVKVLXSNLSMLNLSIRMANLSIVGSHAVNGVSKLHLDTLKMNTFKDFYELWPEKFQYKTNGVTQRRWIVVSNPSLCALISKWLGTEAWIRNADLLTGLRDLVDNTDFRREWTTVEKVNKMRLAEYIETMSGVKVSLDAMFDVQVKRIHEYKRQLLNILGIIHRYDCIKNMDKNDRRKVVPRVCIIGGKAAPGYEIAKKIIKLSHAVAEKINNDTDIGDLLKLVFIPDYNVSVAELVIPGADLSQHLSTAGHEASGTGSMKFMMNGCLLLATADGSTIEIIEEIGSDNLFLFGAKVQEVAELREKGSTLKVPLQFARVLRMVRDGYFGHKDYFESLCDTVEIGNDFYLLGPDFGSYLEAQAAADKAFVEPEKWIKMSILSVAGSGRFSSDRTIQDYAERTWKIDPCRCPL

SEQ ID NO: 7660 - protein, 567 aa, Oryza sativa
MDSARSWLQKLQPRDKDRGKPASPTAARKDGAAAMAEDGEEAISSTTATKVAAAKQFIENHYKDQMRSLEERKERRRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNLSEFDYAVGKNINPSMDGDKLLSSSAAPRRTQQEQLLHWQKNRRMLAYSTVGTPDYIAPEVLLKKGYGMECDLWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEIAPMQTSSKAGPWRKMLSSKDTNFLNFTYKNLELSDDPEHPGIAQVKKKNNKPTRRTFKSILHEFADTEEEPQSSSLNSTPSQLDQLPESLEPSPHSSISSEDSQSRHR

SEQ ID NO: 7661 - protein, 429 aa, Glycine max
  unsure (1)..(429): unsure at all Xaa locations
MALNLTHQPAIKAPSSSSFAASRPLRAPQSVPLRSPQRSLAVRAAATESPAPAVTAVRECKVKSVKARQIVDSRGNPTVEVDLVANGLFRSAVPSGASTGIYEALELRDGDKSVYGGKGVLNAVRNINEVLAPKLVGVDVRNQADVDAIMLEIDGTPNKSKLGANAILGVSLSVCRAGAGAKGVPLYKHIQEIAGTKELVMPVPAFNVINGGSHAGNNLAMQEFMILPVGATSFAEAFRMGSEVYHVLKGIIKAKYGQDACNVGDEGGFAPNVQDNREGLVLLMDAIEKAGYTGKIKIGMDVAASEFYTKDGKYDLNFKKQPNDGAHVHSAQSLGQLYKDFVKEFPIVSIEDPFDQDDWGSWASLLSSVDIQLVRDDLLVTNPKRIAEAIQKKACNGLLLKXNQIGTVTESIXAALDSXLXSWXVMVSH

SEQ ID NO: 7662 - protein, 423 aa, Zea mays
  unsure (1)..(423): unsure at all Xaa locations
MAAVAVSGRLRTLGRGASGAVVSLAWDAASGELVAVKSAGASGAAALRREHAVLAGLRSPHVVRCVGGGEAAAAEEGSSYQLFLEYAPGGSLADEVARSGGSLGEXAVRAFAXDVLRGLAYLHARSVVHGDVKARNVLVGAGGRAMLADFGCARALSGSGSGSARRPIVGATPAFMAPEVARGEDQGPPADVWALGCTVVEMATGRAPFGGMGGAGVLAMVHRIAYTDAVPEVPAWLSPEAGDFLARCFARDAADRWTAARLLEHPFVAFARHDDKAPRPSPKSALDAAAFWESETESEDDADDASGSASASERIDSLACSAGALPDWDGEGGWIDVLGEHCGAPGKASSVLVAVPAGEMDVGGGLPSDDGLEADDVPFGGGDVPVPAADAYEKHCSSSDCHALSCQLVPCNLVFNAIKLWVP

SEQ ID NO: 7663 - protein, 292 aa, Vibrio cholerae
MKGIILAGGSGTRLYPITRGVSKQLLPIYDKPMIYYPLSTLMLAGIRDVLIITTPEDNESFKRLLGDGRDFGIHLQYAIQPSPDGLAQAFLIGEEFIGNDSVCLVLGDNIFYGQSFSKTLRHAASREHGATVFGYQVKDPERFGVVEFDEQMRAISIEEKPSKPKSNYAVTGLYFYDNRVVELAKQVKPSARGELEITTLNEMYLNDGSLNVELLGRGFAWLDTGTHESLHEASSFVETVQHIQGLKIACLEEIAWRNGWLTSEQLLECAKPMLKNDYGQYLERLVKEERHG

SEQ ID NO: 7664 - protein, 415 aa, Nicotiana tabacum
MGNSEDGKPSKPEKSSSPTPDQSNLHVYPDWAAMQAYYGPRVAVPTYFNSAVAPGHTPHPYMWGPQPMIPPYGAPYAAIYAHGGVYAHPGVPIGSHPPGHGMATSPAVSQAMDGASLSLDASAKSSENSDRGLLAMSLGNGSADNIEGGTDHGNSQSGDTEGSTDGSDTNGAGVSERSKKRSRGTTPDNSGDSKSHLRRCQPTGEVNNDSEKTIVVVRPGKVEEKVMGTVLSPSMTTTLEMRNPASTHLKASPTNVSQLSPALPNEAWLQNERELKREKRKQSNRESARRSRLRKQAEAEELAIRVQSLTGENMTLKSEINKLMENSEKLKLENAALMEKLNNEQLSPTEEVSLGKIDDKRVQPVGTANLLARVNNSGSLNRANEESEVYENNSSGAKLHQLLDSSPRTDAVAAG

SEQ ID NO: 7665 - protein, 396 aa, Pseudomonas syringae pv. tomato str. DC3000
MSAQVLRKRICVLPGDGIGVEVMEAALPVIAALGLPFDLLHADIGWECWRREGETVPDDTWKVMASCDATLLGAITSKPLAEAEAELPLPLQGHSRRYVSPVIQLRQNLDLYANVRPVTDMTGENRFRFVVIRENTEGLYAGLDFGRIPDALVPLLEAREALGAAWQRAGQEDATVTLRLQTRSGLTRIFEYAFDYARNNNFSRVTFVDKPMVLRHSSAFARVIFEETAQRYPDITGAIENVDAVALWMVQRPERFGVIVAENMFGDILSDLGAGVMGGLGFAPSGNFGNSGAYFEPVHGSAPAHAGLTKANPSAMFLAIAMMLEHLGYPAQSDCITRAVSLVARSAVRTYDLGGSHTTCQVGEAIVQQCVELQGLLVDRRERSRSAQGERHVSAL

SEQ ID NO: 7666 - protein, 160 aa, Enterococcus faecalis V583
MFKVGIVTLSDRCFQGLAVDQSGPLIREQLPALYQVTKQTILPDEENQLVELLQEWSKTCDLILTTGGTGLSERDRTPEATLRVAERIIPGISEGLRQLSLEKTPFAMLSRGVSVQRGRTLIVNLPGSPKSVTEHLHFLLPVLPHALDLITNKKIIHDEE

SEQ ID NO: 7667 - protein, 507 aa, Streptomyces avermitilis MA-4680
MHNPGHRFQAQDRFADGAQYIAGRFAKGTSGRRHAVVDPATGEEVYRYELAGTADVDAAVAAARAAFPGWAATTPGDRSDALHRFAAVLADRAEEFARAESLQCGKPLKLTREFDVPGTIDNTSFFAGAARHLQGQSAGEYSGDHTSYIRREPIGVVGSIAPWNYPLQMAAWKVLPAIAAGNTIVLKPAEITPLTSLLFAEAATRAGIPDGVVNIVTGAGRDAGEHLVAHPDVAMTSFTGSTAVGRRVAEIATSTVKRLHLELGGKAPFVVFDDADLDAAVHGAVAGSLINTGQDCTAATRAYVQRPLYEEFVARTAALMETVRLGDPFAHGTDLGPLVSHAQRDRVAGFVDRARAYARVVTGGEIPEELKDGAYYRPTLIADAAQDSEIVQSEIFGPVLVVLPFDSDDEGIRLANDTPYGLAASAWSRDVYRANRATREIKAGCVWVNDHIPIISEMPHGGYKASGFGKDMSAYSFEEYTQIKHVMFDNTAIVRKDWHRTIFGDRP

SEQ ID NO: 7668 - protein, 379 aa, Nepenthes alata
AVIGSGVLSLAWAIAQLGWVAGPAVLIAFSAITYFTSTMLADCYRAPDPVTGKRNYTYMDVVKAYLGGRKVQLCGLAQYGNLVGVTIGYTITASISMVAVKRSNCFHKHGHRDGCHTSNNPFMIAFACIQIVFSQIPNFHELFMASPIVAAAMSFAYSSIGIGLSIAKVAGGAHARTSLTGVAVGIDVTSTEKVWRTLQAIGDIAFAYAYANVLVEIQDTLKSSPPENKVMRRASLIGGRPPHSFYVLCGCMGYAAFVYDAPGNFLTGFGFYEPFWLIDFANVCIAIHLIGAYQVFGQPIFAFVEGWCRDMWPENKFITREHPIEVPFVGVYYLNLFRLVWRTTYVIITAIVAMLFPFFNDFLGLIGAASFWPLTVYFP

SEQ ID NO: 7669 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLITYISKVDAQ

SEQ ID NO: 7670 - protein, 359 aa, Brucella melitensis biovar Abortus
MMTQPNLNIVPFVSVDHMMKLVLRVGVETFLKELAGYVEEDFRRWQNFDKTPRVASHSKEGVIELMPTSDGTLYGFKYVNGHPKNTRDGLQTVTAFGVLADVGSGYPMLLTEMTILTALRTAATSAVAAKHLAPKNARTMAIIGNGAQSEFQALAFKAILGVDKLRLYDLDPQATAKCIRNLQGAGFNIVACKSVEEAVEGADIITTVTADKANATILTDNMVGAGVHINAVGGDCSGKTELHGDILRRSDIFVEYPPQTRIEGEIQQLPEDYPVNELWEVITGRIAGRKDARQITLFDSVGFATEDFSALRYVRDKLKDTGLYEQLDLLADPDEPRDLYGMLLRHEKLLQSESTKPAA

SEQ ID NO: 7671 - protein, 192 aa, Triticum aestivum
  unsure (1)..(192): unsure at all Xaa locations
VNIVSNASCTTNCLAPLAKVIHDNFGIVEGLMTTVHAITATQKTVDGPSAKDWRGGRAASFNIIPSSTGXAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 7672 - protein, 576 aa, GIBBERELLA ZEAE PH-1
MAPSADTSFSAHVASQFQSYEEDRQSASKESTYATSNGVPVAHAYEAQRCGENGPLLLQDFHLIDLLSHFDRERIPERVVHAKGSGAHGFFECTDPLDDLCLADIFSAKGKKCPVSMRFSTVGGESGSHDMARDPRGFSVKMRTEEGNLDWVFNNTPVFFLRDPAKFPHFIHTQKRDPSTHLTHADDSFAFWDYLSQNPESIHQVMILMGDRGIPKGYRKMHGYSGHTFKLVNKAGDWVYTQIHLKSMQGTDFVTQEDSADYSPDFSQKDLYEAIQNGDYPKWTLEVQTMTPKEAEELWEKEKINVFDLTHVWPQKQFPRRKVGEFTLNENAINYFAEVEQIAFNPAHLPPGIEPSADPVLQSRLFSYPDTHRHRIGVNYQQLPVNATRTGYKFGNFQRDGQMAFYNQGARPNYLSSIDPIKFRTRTVDLDKTHGHFTGEAITFLTAIRPEDFNAPRALWRNVFDEPARERFINNVTGKMKLCKQEEPLKRQIAIFREVDPEIADRLEKSTGIKGYDGIADMKFNGSHNCMNGEMKLANDIIANKGKSATARNGAPAKGCHSRLETNGHLNGTNGK

SEQ ID NO: 7673 - protein, 470 aa, Gracilaria tikvahiae
  unsure (1)..(470): unsure at all Xaa locations
GVIPYAKMGYWDPDYVIKDTDVLALFRVTPQPGVDPVEASAAVAGESSTATWTVVWTDLLTACDLYRAKAYKVEAVPNTTDQYFAFISYDLDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYAMEGVNRAVAATGEXXXXXXXXXXXXXXXXXXXXXXXXXXXXXXXXIVXVIGYTAIQTMAIWARKNDMILHLHRAGNSTYSRQKSHGMNFRVICKWMRMAGVDHIHAGTVVGKLEGDPLMIRGFYNTLLETNLEINLPQGIFFEQDWASLRKVTPVASGGIHCGQMHQLLDYLGVDVVLQFGGGTIGHPDGIQAGATANRVALEAMVIARNEKRDYVAEGPEILRDAAKTCGPLQTALDLWKDITFNYTSTDTADFVETPTANV

SEQ ID NO: 7674 - protein, 264 aa, Candida albicans
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 7675 - protein, 484 aa, Proteus mirabilis
MEKKKLTTAAGAPVVDNNNVITAGPRGPMLLQDVWFLEKLAHFDREVIPERRZHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 7676 - protein, 269 aa, Mangifera indica
NHGISHDLMDGVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKA

SEQ ID NO: 7677 - protein, 430 aa, Zea mays
MGFGMGNNNNGASSSSSRLDPAAPLLPRHGSSGGREGGGLSSQPKTFANVFIAVVGAGVLGLPYTFSRTGWAVGSLLLFSVAALTFYCMMLLVACRRRLADEHPKIASFGDLGDTVFGAHGRFAVDVMLVLSQFSFCVGYLIFISNTMAHLYPIAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 7678 - protein, 159 aa, Triticum aestivum
MAGMVFGLENPMMTALQHLLDIPDGETGAPGGEKQGPTRAYVRDARAMAATPADVKELPGAYAFVVDMPGLGSGDIQVQVEDERVLVISGERRREEKEDTKYLRMERRMGKLMRKFVLPENADMEKISAVCRDGVLTVTVEKLPPPEPKKPKTIQVQVA

SEQ ID NO: 7679 - protein, 422 aa, Arabidopsis thaliana
MAFSSLLRSAASYTVAAPRPDFFSSPASDHSKVLSSLGFSRNLKPSRFSSGISSSLQNGNARSVQPIKATATEVPSAVRRSSSSGKTKVGINGFGRIGRLVLRIATSRDDIEVVAVNDPFIDAKYMAYMLKYDSTHGNFKGSINVIDDSTLEINGKKVNVVSKRDPSEIPWADLGADYVVESSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 7680 - protein, 169 aa, Bacillus anthracis str. A2012
MSVTEHKKQAPKEVRCKIVTISDTRTEETDKSGQLLHELLKEAGHTVTSYEIVKDDKESIQQAVLAGYHREDVDVVLTNGGTGITKRDVTIEAVSALLHKEIVGFGELFRMISYLEDIGSSAMLSRAIGGTIGRKVVFSMPGSSGAVRLAMNKLILPELGHITFELHRQ

SEQ ID NO: 7681 - protein, 371 aa, Lactobacillus sakei
MEIANFGVEEWLNVYETQATLDIAQSTIASMTMSELMALSPDNGTQFYQDLAQQKMNYGAIEGSEAFKQAVSELYQTVNSNQVLQTNGATGANLLALYALVKPGNHVITMFPTYQQLYEIPISIGATVSYWQLDEDNNWVPDIAELKKLIRPETKLICLNNANNPTGTVISTELMQAIVEVARTVGAYVLVDEVYLPLGEGQQTTSIADLYELGIATNSLSKTYSVPGIRVGWLVANETLTDLFRKYRDYTMICAGVFSDQLAVYVLQNRKQVLARNRALVQHNLEIFKAWVAQEPLVDVVYPESVSTSFIHFKEIEDDEAFCKYLLKEYGVLLVPGKRFEIPGHARLGYCAPEATLKKGLAELSKALRTY

SEQ ID NO: 7682 - protein, 364 aa, Actinidia arguta
MNLADAMARARVFDIDLQKQLRPYMESMVPLPGIYEPDFIAANQGSRANNVIKGSKKEQVDQIIKDIREFKEKNKVDRVVVLWTANTERYSNVIVGLNDTMENLFASLEKNESEISPSTLYAIACVLENIPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYMSEIFMGGKNTIVLHNTCEDSLLAAPIILDLVLLAELSTRIQLKADGEGKFHSFHPVATILSYLTKAPLVPPGTPVVNALSKQRAMLENILRACIGLSPENNMILEYK

SEQ ID NO: 7683 - protein, 112 aa, Lycopersicon esculentum
MAGKMSIVLFVLLVVFLTQNQVSRANIMRDEQQQQQRNNQLYGVSEGRLHPQDCQPKCTYRCSKTSYKKPCMFFCQKCCAKCLCVPAGTYGNKQSCPCYNNWKTKRGGPKCP

SEQ ID NO: 7684 - protein, 96 aa, Glycine max
VEVGGFCVTELTQQYQTRPCSSKSTEHQNYTSSSQEDLVYVGKLVAGSFAGGAAIKYGSALFPEITTPNLVVALLLILTPVLVAVFLLIKESRTNP

SEQ ID NO: 7685 - protein, 168 aa, Avena clauda
VMASSATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 7686 - protein, 336 aa, Glycine max
SSQDKIHTKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREMGKQLWECIAFMHDLRMIHTGPKPENILLVSPEYVKVPDYKSSSRSSCSYFKRVPKSSAIKVIDFGSTTYEREDQNYIVSTRHYRAPEVILGLGWSYPCDIWSVGCILVELCTGEALFQTHENLEHLAMMERVLGSLPQTMMKRVDRHAEKYVRRGRLDWPEGATSRESIKAVMKLPRLQNLVMQHVDHSAGDLIHLLQGLLRYDPSERLTAKEALRHSFFMREHFRR

SEQ ID NO: 7687 - protein, 553 aa, Pseudomonas aeruginosa UCBPP-PA14
MQTVYTVLTLLLVVGATRLAAQLLPLPLPLIQIAAGALLALPSLGLHIALDPELFLFLFIPPLLFVDGWRIPKREVWRMRWPILMMAFGLVFFTVVGAGYFIHLLIPEIPLAASFALAAVLSPTDALAVSAITQGRLPKRLMHLLEGEALMNDASGLVAFKFAIAAAMTGVFSLVDASLNFLLVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 7688 - protein, 190 aa, Triticum aestivum
  unsure (1)..(190): unsure at all Xaa locations
MAPTVMASSATSVAPFQGLKSTAGLPVSRRSNGASLGSVSNGGRIRCMQVWPIEGIKKFETLSXYLPPLSTXEALLKQVDYLIRSKWVPCLEFSKVGFIFREHNAXSPGYYDGRYWTMWKLPMFGCTDATQVINEVEEVKKEYPXDAYVRIIGFDNMRQVQCVSFIAFKPPGXCEESGKALNSSLTTGHI

SEQ ID NO: 7689 - protein, 198 aa, Streptococcus pneumoniae
GIEDILVVTGKSKRSIEDHFDSNFELEYNLKEKGKHDLLKLVDETTGIRLHFIRQSHPRGLGDAVLQAKAFVANEPFVVMLGDDLMDITDDNAVPLTKQLMNDYESTHASTIAVMPVPHEEVSAYGVIAPQGEGINGLYSVETFVEKPAPEDAPSDLAIIGRYLLTPEIFEILENQAPGAGNEIQLTDAIDTLNKTQR

SEQ ID NO: 7690 - protein, 472 aa, Salmonella typhimurium LT2
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 7691 - protein, 119 aa, Glycine max
EGPPLVECETYRFRGHSLADPDELRDPAEKAHYAGRDPISALKKYMIENKLASEQELKTIEKKIEEIVEDAVEFADESPHPPRSQLLENVFADPKGFGIGPDGKYRCEDPKFTQGTAHV

SEQ ID NO: 7692 - protein, 256 aa, Zea mays
MASRKFFVGGNWKCNGTGEDVKKIVTVLNQAEVPSEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 7693 - protein, 556 aa, Saccharomyces bayanus
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 7694 - protein, 144 aa, Streptococcus agalactiae 2603V/R
MKETQEELRQRIGHTAYQVTQNSATEHAFTGKYDDFFEEGIYVDIVSGEVLFSSLDKFQSGCGWPAFSKPIENRMVTNHQDHSHGMHRIEVRSRQADSHLGHVFNDGPVDAGGLRYCINSAALDFIPYDQMAKRGYGDYLSLFD

SEQ ID NO: 7695 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 7696 - protein, 163 aa, Triticum aestivum
MARAPLPGPALPLLAVILLLVGRRGAAGAGGGGGGRGSSVYPAPVVYPHHSRQISWHPRAFLYPHFLTDDEANHLVSLARAELKRSAVADDTSGKSKLSEVRTSSGTFIGKGQDPIVAGIEDKIAAWTFLPKENGEDMQVLRYKRGEKYEPHHDFFTDRVNTI

SEQ ID NO: 7697 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRENKANPVALLLSSAMMLRHLQFPSFADRLETAVKKVISEGKCRTKDLGGQSTTQEVVDAVIAKLE

SEQ ID NO: 7698 - protein, 457 aa, Spatoglossum pacificum
DYNVKDTDILALFRITPQPRVDPVEAAAAVAGESSTATWTVVWTDLLTACDIYRAKAYRVDPVPGTTDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLRGGLDFLKDDENINSQPFMRWKERFLYCMEGVNRAAAATGEIKGSYLNITAATIEQMYERAEYADSLGTVIVMIDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEGRDYVEEGPEILRNAATTCGPLKAALDLWKDITFEYTSTDTPDFVEVPTPGN

SEQ ID NO: 7699 - protein, 606 aa, Oryza sativa
  unsure (1)..(606): unsure at all Xaa locations
MELALVGDPSNGVAKPSCDSVGSLPAVSSKAVIHPPVTSAAGATLGRHLARRLVQIGATDVFAVPGDFNLTLLDYLIAEPGLKLIGCCNELNAGYAADGYARXRGVGACAVTFTVGGXFSVLNAIAGAYSENLPVICIVGGPNSNDYGTNRILHHTIGLPDFSQELRCFQTITCYQAVINNLDDAHEQIDTAIATALRESKPXYISLGCNLGGLFNPTFSRESVPLFISPRLSNKANLEYAVEAAADFLNKAVKPMMVGGPKFRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKELLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 7700 - protein, 374 aa, Pseudomonas aeruginosa PAO1
MPALSRRSFVTLTALASSSILLSPRAFAGSGATSAAGKPQETFLDFNESPYGPSAKARAAMQRAAALCGRYDYDAQDALVGLFAKQNGIPAECVHAYCGSRQPLQYAVAAFTGKERGLVIADPSYDSVVGAAQAQGAKVAAVPLDAEAAHDIERMLAAAQRDAGLIYICNPNNPTGTLTPHERIVRAIERKPERSVVLVDEAYIHFSDAPSVVGLAVQRQDVLVLRTFSKLYGMAGARLGLAIGHPQLLARLERFGGHNVVPSPTAHAGLESLRDDDLVPRRKQQNAEVRERTIAWLRQQGFRCTASQSNCFMVDMRRPAELVIAELEKQRVHVGRPWASWPNWVRVTVGSEEEMQAFRSAFASVSRRHQVAMR

SEQ ID NO: 7701 - protein, 198 aa, Triticum aestivum
  unsure (1)..(198): unsure at all Xaa locations
GFAVYADRFVDPALGFSLGYTYWFKYIITTPNQLTAGALVISYWLPADRVNPGVWITIFXVLIVTINVLGIKYFGEIEFWLSSIKVLVILGLILLSLIIALGGADGDVRGFRYWNNPGAFNPYKGSGSWGRFLAVWQSMVTAVFAYLGTELVGVTVGEAQNPRKNVPRAIKLTFYRICVFYICSVILLGMCVPRPRPR

SEQ ID NO: 7702 - protein, 210 aa, Triticum aestivum; identical to SEQ ID NO: 2108

SEQ ID NO: 7703 - protein, 409 aa, Caulobacter crescentus CB15
MATETSDKPALARRSFLRSAAFLATAAPIMTEASLAYAAQTPAPPSGMALHGQSANAPPSGMVLINANENPLGPSKAACDAIARVAPLGGRYDLTGETELLTKTIAAQSGLKPEFIAVYAGSSEPLHYSVLAFTSPTKSFVTADPSYEAGMFAARTSQAKIIKTPLTSAFAHDVKAMVAADAQAGVIYICNPNNPTGTLTTKKDIVWALENKPAGSILLVDEAYIHLTDEPDTLDLVAQGKDLIVLRTFSKIYGMAGIRCGFAAGRPDLLAKLKPFGQNAMPITGSAAARASLEDPKLVPERRKMIGDTRRDTIAWLKTNGYKVIGDPQTNCFMIDTGRNGRAVMAAMKARNVMIGRTWPIWPNAVRVSVGTPEEMAAFKVAFKAVMDGPPLAEADHVQLAQLDGYVAL

SEQ ID NO: 7704 - protein, 181 aa, Zea mays
  unsure (1)..(181): unsure at all Xaa locations
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 7705 - protein, 555 aa, Eremothecium gossypii
MSSVNKENYRGVPSGRGMKNPVLAGAKRAVLNNVTNTTLSQEAANSNAHSGSGYTNSFGKVLRQAKSKLQSARVAGSLIPQMKREGLASSQEDKENVVPTGVAPAAVAAAAAAAQMAPAIAKPILQSISEESHQECQSLLKDGGSDEGASTVSTKSSDTELAPSSSSSLQSAPANSEEPVVLESGTQLVERRRPQTLNTTLTGSVASSSDCTTSTGQLTESTAGELTTTQNQLRPSVAVAESKKKRPISTIVEPEELKKFKISDQGNQCEWEDLDAEDINDPFMVSEYVNDIFEYLHKLEVMTLPNRHDLFKHANIQQNRDILVNWMVKIHNKFGLLPETLYLALNIMDRFLGKELVQLEKLQLVGTACLFIASKYEEVYSPSVKHFAYETDGACDEEEIKEGEKFILKTLQFNLNYPNPMNFLRRISKADDYDIQSRTLAKYLLEISVVDFKFIGILPSLCAAASMFLSRKMLGKGKWDGNLIHYSGGYSTTELAPICNMLMDYLVQPVVHDELFKKYASRRFMKASVISRQWAKKVMTRSYDIMTLHETQTEY

SEQ ID NO: 7706 - protein, 674 aa, Arabidopsis thaliana
MGQDSNGIEFHQKRHGLLKDQVQLVKRRDSIRYEIVSIQDRLSFEKGFFAVIRACQLLSQKNDGIILVGVAGPSGAGKTVFTEKILNFLPSVAVISMDNYNDSSRIVDGNFDDPRLTDYDTLLKNLEDLKEGKQVEVPIYDFKSSSRVGYRTLDVPPSRIVIIEGIYALSEKLRPLLDLRVSVTGGVHFDLVKRVLRDIQRAGQQPEEIIHQISETVYPMYKAFIEPDLQTAQIKIINKFNPFTGFQSPTYILKSRKEVSVDQIKAVLSDGHTETKEETYDIYLLPPGEDPESCQSYLRMRNKDGKYSLMFEEWVTDTPFVISPRITFEVSVRLLGGLMALGYTIATILKRNSHVFATDKVFVKIDWLEQLNRHYMQVQGKDRQLVQSTAEQLGLEGSFIPRTYIEQIQLEKLINEVMALPDDLKNKLSLDEDLVSSSSPKEALLRASADRVAMRNKNLKRGMSHSYSTQRDKNLSKLAGYSSSDRRYEERNHDSPANEGFMTLLSEQISSLNERMDEFTSRIEELNSKLSCNKNSPTQQSLSIQTEVCNGSAPTSYFISGLDNGCLTNSIMPHSSSSSQLAKDSPLMEEISTISRGQRQVMHQLDNLCNLMRESSAERSRLARTGSSNSGNRGRSSKSSFLSNVESNKLPLVLTVAICSIGIIVIKSYINKRQ

SEQ ID NO: 7707 - protein, 471 aa, Pichia angusta
MSLDTEVDKIVSEFAVTQETLQKGVERFIELATAGLNSDEDKYGLPMIPTFVTSIPTGKEKGILFAADLGGTNFRVCSVALNGDHTFKLIQQKSHIPAELMTSTSDELFSYLASKVKNFLETHHEGAVTSTGSQKFKMGFTFSFPVSQTALNAGTLLRWTKGFNIPDTVGQEVVSLFQMHLDAQEIPVTVSALSNDTVGTLLARSYTGSNKEGTTVLGCIFGTGTNGAYNEKLENIKKLPAEVREKLKAQGVTHMVINTEWGSFDNQLKVLPNTKYDAQVDELTGNKGFHMFEKRVSGMFLGEILRHILVDLHSKGVLFTQYASYESLPHRLRTPWDLDSEVLSLIEIDESTNLQATELSLKQALRLPTTTEERLAIQKLTRAVAKRSAYLAAIPIAAILHMTESFKGHNVEVDVGADGSVVEFYPGFRTMMRDAIAQTQIGAKGERRLHINIAKDGSSVGAALCALSEKD

SEQ ID NO: 7708 - protein, 593 aa, Shigella flexneri 2a str. 2457T
MAKMRAVDAAMYVLEKEGITTAFGVPGAAINPFYSAMRKHGGIRHILARHVEGVSHMAEGYTRATAGNIGVCLGTSGPAGTDMITALYSASADSIPILCITGQAPRARLHKEDFQAVDIEAIAKPVSKMAVTVREAALVPRVLQQAFHLMRSGRPGPVLVDLPFDVQVAEIEFDPDMYEPLPVYKPAASRMQIEKAVEMLIQAERPVIVAGGGVINADAAALLQQFAELTSVPVIPTLMGWGCIPDDHELMAGMVGLQTAHRYGNATLLASDMVFGIGNRFANRHTGSVEKYTEGRKIVHIDIEPTQIGRVLCPDLGIVSDAKAALTLLVEVAQEMQKAGRLPCRKEWVADCQQRKRTLLRKTHFDNVPVKPQRVYEEMNKAFGRDVCYVTTIGLSQIAAAQMLHVFKDRHWINCGQAGPLGWTIPAALGVCAADPKRNVVAISGDFDFQFLIEELAVGAQFNIPYIHVLVNNAYLGLIRQSQRAFDMDYCVQLAFENINSSEVNGYGVDHVKVAEGLGCKAIRVFKPEDIAPAFEQAKALMAQYRVPVVVEVILERVTNISMGSELDNVMEFEDIADNAADAPTETCFMHYE

SEQ ID NO: 7709 - protein, 465 aa, Solieria sp.
AKMGYWDPEYVVKETDVLALFRVTPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYAMEGVNRSIAASGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVLARNEGRDYVAEGPQILQDAAKTCGPLQTALDLWKDITFNYTSTDTADFVETPTANV

SEQ ID NO: 7710 - protein, 126 aa, Oryza sativa
LSIIEYLWRVKQPYNVSVAAEVSACAALQNPAYLEEVKNLLLQERDRLYDLLKEIPFLKPFPSPSNFILCEVPSGKDAKKIKEALAKMGVMIRPYAKKELKGYIRISVGKPEHTDALMKGLKALQL

SEQ ID NO: 7711 - protein, 543 aa, Glycine max
ARGSVVSKLQTLSTSDHASVVSMNLFVALLCGCIVLGHLLEENRWMNESITALLIGVCTGVVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDSSIAVHFLGNFLYLFIASTMLGVLTGLLSAYIIKKLYIGRHSTDREVALMMLMAYLSYMLAELCYLSGILTVFFCGIVMSHYTWHNVTESSRITTKHSFATLSFVAEIFIFLYVGMDALDIEKWKFVSDSPGTSVATSGVLLGLILLGRAAFVFPLSFISNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 7712 - protein, 158 aa, Coccidioides posadasii
GAFDNERVVLPLTQYDVVIDRDSPRPGQQAFEKMTAGLYLGEIFRLVLLDLIDNKGNLIFEGQDVSSLRKPYCLDSSFLAYIEEDPFENLSETRDLFERNLGIKATKPELELCRRLAELIGTRAARLSACGVAAICKKKNIKSCHVGADGSVFNKYPH

SEQ ID NO: 7713 - protein, 160 aa, Oryza sativa
MDLAAVHAALAGKSYSSVAPLCDDLFLQAASRGAATDGWPYAVHLLAHLYLNDLNSARFLWKSTPQEAKDARPELAAVWRIGQCLWNRDYAGVYAAAQGFEWSPEIADFVAAFLDAMQNGWSLDAAARMLTVVKPKVKTNQKLDASKLQRLTECVFHLEH

SEQ ID NO: 7714 - protein, 383 aa, Nicotiana sylvestris
RGSPESLRDIRGFAVKFYTREGNFDLVGNNVPVFFNRDAKSFPDTIRALKPNPKSHIQEYWRILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWISYLSQADKSCGQKVASRLTLKPTM

SEQ ID NO: 7715 - protein, 572 aa, Photobacterium profundum
MEMLSGADMIVRSMIDQGVKHIFGYPGGSVLDIYDALHEKSDIEHVLVRHEQAAVHMADGYARATGDVGVVLVTSGPGATNAITGIATAYMDSIPMVVFSGQVMSNLIGNDAFQECDMVGISRPVVKHSFLIKKAQDIPEIIKKAFYIASSGRPGPVVIDIPKDMLNPAETYPYQYPESIAMRSYNPTTQGHKGQIKRGLKALLSAKKPVLYVGGGAVISECDQQILKLAESLNLPVVNTLMGLGAFPGTHKNCLGMLGMHGTYEANMAMHNADLIFGIGVRFDDRTTNNVDKYCPNATIMHIDIDPSSISKTIAVDIPIVGSAETVLDCMLKMLDEQESSNDQEAIASWWADLESWRSRKCLSYETNNERIKPQQVIESLYKLTNGDAYVASDVGQHQMFAALYYPFDKPRRWINSGGLGTMGFGLPAAMGVKFALPDAEVVCVTGDGSIQMNIQELSTALQYDIPVKIINLNNRFLGMVKQWQDMIYQGRHSHSYMDSVPDFAAIAEAYGHVGVRISDPAKLDSELEKALAMKDKLVFVDISIDETEHVYPMLIRGGSMSEMWLSKTERT

SEQ ID NO: 7716 - protein, 115 aa, Zea mays
  unsure (1)..(115): unsure at all Xaa locations
QDNKVHGRRARLLFVVDNMRLPVDYGQMAGVGRITYTFLSPPPNAHYAKFDWKPTCPVRGILTHGQEALGGKPNHRRLTQELSYCIVAEQLLLRTLYVQVMDXPNTDDQFDFDRL

SEQ ID NO: 7717 - protein, 275 aa, Enterobacter cloacae
IGQALALLLKTQLPSGSELSLYDIAPVTPGVAVDLSHIPTAVKIKGFSGEDARPALQGADVVLISAGVARKPGMDRSDLFNVNAGIVKNLVQQIAEICPKACIGIITNPVNTTVAIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRALQGEKGVVECAYVEGDGEHARFFSQPLLLGKNGIEERKSIGTLSA

SEQ ID NO: 7718 - protein, 146 aa, Glycine max
GTRQLSSKLLSGSKPSFNNNFKQSRFYSTPTLKFQVKPYDLHRLDKGPSLEVETNKEDLVSAFKTMYEIRQMEIIADKMYKAKKIQGFLHLYNGEEAVVTGIESGIRPDDHVITAYRDHGFILTRGGNAEQVFAELQGKVTGTSRG

SEQ ID NO: 7719 - protein, 533 aa, Corynebacterium efficiens YS-314
MTENSAADQIIDRGMRPKVAGNTTRHNGAPVASENISVTAGPQGPNILNDIHLIEKLAHFNRENVPERIPHAKGHGAFGELHITEDVSQYTKADLFQPGKVTPMGVRFSTVAGEQGSPDTWRDVHGFALRFYTQEGNYDIVGNNTPTFFVRDGMKFPDFIHSQKRLNKNGLRDADMQWDFWTRAPESAHQVTYLMGDRGTPKTTRHMNGYGSHTFQWVNKDGEAFWVKYHFISRQGVENFTDAEAAEMAGINADYHREDLYNAIERGDYPIWDVKVQIMPFAEAENYRWNPFDLTKVWSKKDYPRIDVGYFILNRNPRNFFAQIEQIALDPGNIVPGVGLSPDRMLQARAFAYADQQRYRIGPNYRDLPINRPINEVNTYSREGHMQYVFDAEGEPSYSPNRYTKGAGYLDDGETSSSNHTSYGQASDIYVNPDPHGTDLVRAAYVKHQDDDDFMQAGILYREVYNDEEKARLADNISNAMQGISEETEPRVYEYWTNVDENLGARVKELYLQKKAAGAAEHTSSTGDDIDKK

SEQ ID NO: 7720 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 7721 - protein, 448 aa, Phycodrys ovifolia
LALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMENMYERAEFAKQLGSIIIMIDLVIGYSAIQSMGIWARQNDMILHLHRAGNSTYSRQKIHGMNFRVICKWMRMAGVDHIHAGTVVGKLEGDPLMIKGFYDTLLLPYLDVNLPEGIFFKQDWAALRKVTPVASGGIHCGQMHQLLDYLGNDVVLQFGGGTIGHPDGIQAGATANRVALESMVIARNEGRPYVQEGPEILRDAAKTCGPLQTALDLWKDITFNYTSTDTADFVASPTANV

SEQ ID NO: 7722 - protein, 759 aa, Metarhizium anisopliae
MTTPALIDHSPHQPEPSPPVATASNLILIDNYDSFTWNIYQYLVLEGATVHVFRNDQITIEELVKKNPTQLIISPGPGHPTTDSGVSRDAIRHFAGKIPIFGVCMGLQCMFDVYGGQVDSAGEWLHGKTSPLTHDSKGVFAGLEQGLPVTRYHSLAGTRLTLPECLEVTSWVAKDDGSQGIIQGVRHKKFAMEGVQFHPESILTAHGRTIIKNFLHMQGGTWEENAQLHKTAATNGTATASLPKKNNILQRIYANRRAAVEAQKHIPSQRMSDLEAAYELNAAPPQVPFLARLKQTPFDVALMAEIKRGSPSKGIFALEINAPVQARKDKGAGTSDISVLTEPEWFKGSIEDLRAVRQVLDGMPTGLPFYERSLFDEYQILEAKTARADTVLLIVKMLETELLERLYKYSLSLGMEPLVEVQTAEEMEIAVKLGSKVIGVNNRNLESFEVDMDTTGRLRKMVPESTVICALSGINSHKDVLACKNDGVNAILVGESIMRAPDATSFIAELCSGSKPAEKKRQPKPLFVKVCGTRSPEAAKQAVESKADFVGIILVPGTKRCVSHETALAISEAVHASGDNLADRKEEPVPKSGATDFFAAAADRLQSSRTRLVGVFQNQPLSEVLEKQRLYKLDMVQLHGEEPIEWAKIITVPVIRSFKPDHVGIGLRGYHTIPLLDSGAGSGKLLDVSKVKAALERDPDLRIFLAGGLNPENVTEAVKALGDLSDRVIGVDVSSGVEEGGKQSIERIDAFVRAGKAIR

SEQ ID NO: 7723 - protein, 501 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLAFKARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 7724 - protein, 265 aa, Nicotiana tabacum
AHGGVYAHPGVPIGSHPPGHGMATSPAVSQAMDGASLSLDASAKSSENSDRGLLAMSLGNGSADNIEGGADHGNSQSGDTEDSTDGSDTNGAGVSERSKKRSRETTPDNSGDSKSHLRRCQPTGEINDDSEKAIVAVRPGKVGEKVMGTVLSPSMTTTLEMRNPASTHLKASPTNVSQLSPALPNEAWLQNERELKREKRKQSNRESARRSRLRKQAEAEELAIRVQSLTAENMTLKSEINKLMENSEKLKLENAALMERLKMNS

SEQ ID NO: 7725 - protein, 467 aa, Pterocladia lucida
  unsure (1)..(467): unsure at all Xaa locations
PYAKMGYWDPDYIVKDTDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIASTGEIKXXXXXXXXXXXXXXXXXXXXXXXXXXXXXXXXXXXXXXAIQTMAIWARRNXMILHLHRAGNSTYSRQKIHGMNFRVICKWMRMAGVDHIHAGTVVGKLEGDPLMIKGFYNTLLLTHLEVNLPQGIFFEQDWASLRKVTPVASGGIHCGQMHQLLDYLGDDVVLQFGGGTIGHPDGIQAGATANRVALEAMVIARNEGYDFVAEGPQILRDAAKTCGPLQTALDLWKDISFNYTSTDTADFVETPTANV

SEQ ID NO: 7726 - protein, 220 aa, Aspergillus niger
PRVRQHKAFIGGDDFKSGQTKMKSALVDFLINAGIKLTSIASYNHLGNNDGKNLSSQKQFRSKEISKSNVVDDMVAANKILYAEDEHPDHTVVIKYMPAVGDNKRALDEYYAEIFMGGHQTISLFNICEDSLLASPLIIDLVLIAEMMTRISWKSDEAAEYKGFHSVLSVLSYMLKAPLTPPGTPVVNSLTKQRSALTNIFRACVGLQPESEMTLEHKLF

SEQ ID NO: 7727 - protein, 293 aa, Vitis vinifera
DACENWGFFELVNHGISHELMDTVEKLTKEHYKKCMEQRFKEMVASKGLEAVQSEINDLDWESTFFLRHLPTSNMSEIPDLEEDYRKAMKEFTAHLEKLAELLLDLLCENLGLEKGYLKKAFYGSQGPSFGTKVSNYPPCPQPELIKGLRAHTDAGGIILLFQDDKVSGLQLLKDGQWIDVPPMRHSIVISLGDQLEVITNGKYKGVMHRVIAQTDGNGMSLASFYNPGSDAVIYPAPALVEKEKETSEVYPKFVFEDYMKLYAGLKFQAKEPRFEAMKAMEPTVNLGPIATV

SEQ ID NO: 7728 - protein, 324 aa, Schizosaccharomyces pombe
MSESEQLLEKQQDHKWDAATHADKGITIKTGKIAVSSSDIPLRNRKGLLTWDQLEPWQQDNQYIISGYRPPSFSFYLCVKSIFHVHNESVNIWTHLFGAIVFLFFIFKSELILKRDTTTAEDVYVITVFLFSAFTMLGCSTFYHTISNHSDDVSKFGNKLDYLGIVVMIVGSFIPCLHYAFACHANFRTLYIGTIIGIGVIVASTCLLDRFRQPEWRPYRALIFVLMGLFGIFPVIHALKIFSFSEILVRMGLVWLLLQGLFYIVGAVIYALRIPEKWSPGKYDVFGSSHQWFHVCVIIAAFCHFHGVCIAYDYFHERRGCGEM

SEQ ID NO: 7729 - protein, 309 aa, Nicotiana tabacum
MAGSGVVTLYGNGALTETTKQSPFSVKVGLAQMLRGGVIMDVVNAEQARIAEEAGACAVMALERVPADIRAQGGVARMSDPQLIKEIKQAVTIPVMAKARIGHFVEAQILEAIGIDYVDESEVLTLADDENHINKHNFRIPFVCGCRNLGEALRRIREGAAMIRTKGEAGTGNIIEAVRHVRSVMGDIRVLRNMDDDEVFTFAKKLQAPYDLVMQTKQLGRLPVVHFAAGGVATPADAALMMQLGCDGVFVGSGIFKSGDPAKRGRAIVQAVTHYSDPGLLAEISCGLGEAMVGINLDDKVERYANRSE

SEQ ID NO: 7730 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKGLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 7731 - protein, 396 aa, Macfadyena unguis-cati
MALKLNAINFQSPKCSSFGLPPVVSLRSPKLSVAATLRSGLRDVETVKKTFSPAREVHVQVTHSMAPQKIEIFKAMEDWAENNILVHLKNVEKCPQPQDFLPDPASDEFHDQIKELRERAKEIPDDYFVVLVGDMITEEALPTYQTMLNTWDGVRDETGASPTSWAIWTRAWTAEENRHGDPLNKYLYLSGRVDMKQIEKTIQYLIGSGMDPRTENSPYLGFIYTSFQERATFISHGNTARLARDHGDFKLAQICGTIASDEKRHETAYTKIVEKLFEIDPDGTVLAFGDMMKKKISMPDHFMYDGRDDNLFDHFSSVAQRLGVYTAKDYADILEHLVGRWKVEKLTGLSAEGQKAQDYVCGLPPRIRRLEERAQIRAKQAPRLPFSWIYDREVQL

SEQ ID NO: 7732 - protein, 224 aa, Lycopersicon esculentum
MGRGRVELKRIEGKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQCSQMHKLWAMAGKQLKLRAMASFILWIVNLLCKLGIRMIQLQ

SEQ ID NO: 7733 - protein, 754 aa, Clostridium stercorarium
MQRDIKKIISQMTLEEKASLCSALDAWTLKGVERLGIPSIMVSDGPHGLRKRQRDPTDPGKKTTVPATCFPTAVGLASSWNRELVEKVGPALGEECQAEGIAVLLGPGTNIKLSPLSGRNFEYFSEDPYLSSEMARSHIKGVQSRGVGTSLKHFAANNQEHRRMSVDAVIDERTLREIYLASFEGAVKKAKPWTIMCSYNRVNGEYASENKFLLTDVLRNEWGFEGIVVSDWGAVNERVKGLEAGLDLEMPSSFGIGDQKIVEAVKKGELPEEVLDRTVERILNLIFKAVDNRKENAGYDREAHHKLAREAARECMVLLKNEDKILPLRKQGTIAVIGEFAKRPRYQGGGSSHVNPTIMDSPYEEIKKSAGNNADVIYAQGYIIEKDEPDEKLLEEAKQTALKADVAVIFAGLPEHYECEGYDRTHMRMPESHCTLIEEVAEVTTNVVVVLCNGSPVEMPWIDKVKGLLEAYLGGQAMGGPLPIFCSETPIPGKLAETFPKQLSDNPSYLNFRERDRVEYREGIFVGYRYYDKKNMEPLFPFGYGLSYTTFEYGDLKISRKEISDNETVTVSVKVKNTGDMAGKEIVQLYVRDIETSVIDRRRTEGFEKVELQPGEEKTVVFELDKRAFAYTHRYKDWHVETGEFRDFIGRSSRDIVLKDKIFVKSTVTIKKRWTVNTLVGDLLSDRVLEPVFREFIINEIKTWYLLDLLDEDNHLLSVWMRYTPLRSLANSTGGELNEEKLNRLIDTLNANIK

SEQ ID NO: 7734 - protein, 247 aa, Zea mays
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQQQQETSSSNGSVVKGSILERCPDLNLELTISPPRQQQQTQKNLCFVCSLGLHNSKDCSCNVSNAVTVNNTTPSSAAAAAAYDFLGMKTSGVWDCTRLEMK

SEQ ID NO: 7735 - protein, 281 aa, Arabidopsis thaliana
MSTSAASLCCSSTQVNGFGLRPERSLLYQPTSFSFSRRRTHGIVKASSRVDRFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQQSTIHLHRTVNQIKSLGAKAGVVLNPGTPLSAIEYVLDMVDLVLIMSVNPGFGGQSFIESQVKKISDLRKMCAEKGVNPWIEVDGGVTPANAYKVIEAGANALVAGSAVFGAKDYAEAIKGIKASKRPAAVAV

SEQ ID NO: 7736 - protein, 110 aa, Glycine max; identical to SEQ ID NO: 6810

SEQ ID NO: 7737 - protein, 439 aa, Desulfovibrio desulfuricans G20
MALFTKEEALKYHEAPRPGKLEVVPAKPCRNQKDLSMAYSPGVAEACKAIREDPAKAALYTGRSNLVGVVSDGSAVLGLGNIGPLAGKPVMEGKGVLFKTFADIDVFDINLDVRSADQLIEVVKTLEPTFGGINLEDIKAPECFYIEETLKREMNIPVFHDDQHGTAVISGAGLLNALDITNRRAEDMKVVIVGAGAAGIACATFYVALGVDPANIYMFDSRGLIHAGRSDLNSYKKRFAQKKDAGSLEDVMKGADMFLGLSTKDLVSKDMVRAMAKDPVLFAMANPDPEIAYPDAKEACPGCIMGTGRSDFPNQVNNVSGFPYIFRGALDVGATEINEAMKIAAARSLAALAREPVPAEICALYGVDSLEFGVDYVIPKPLDPRVLEWETPAVAQAAMDSGVATVPVADMKAYAASLRVRVDAAARRAAAVVDSYSGV

SEQ ID NO: 7738 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELKGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 7739 - protein, 137 aa, Escherichia coli O157:H7 EDL933
MANKPSAEELKKNLSEMQFYVTQNHGTEPPFTGRLLHNKRDGVYHCLICDAPLFHSQTKYDSGCGWPSFYEPVSEESIRYIKDLSHGMQRIEIRCGNCDAHLGHVFPDGPQPTGERYCVNSASLRFTDGENGEEING

SEQ ID NO: 7740 - protein, 402 aa, Arabidopsis thaliana
MSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 7741 - protein, 285 aa, Methanothermobacter thermautotrophicus str. Delta H
MKAVIPAAGLGTRFLPATKAQPKEMLPVFDKPTIQYVVEEAVASGIDDILIITGKGKRSIEDHFDRSFELEYFLRKNNKMNYLDEVEAISDLADIYFVRQKEQKGLGDAIYCARKHIDGEDAFAVLLGDTITSSGVPCTRQLMDIYERYGASAIAVEEVPRDKVERYGIIDGEEVSEGIYSIRDMVEKPPVTEAPSNLAIMGRYVLESEIFDHIREVPPGFGGEIQLTDAMRCLEEVYGCVFRGRTYDIGNRVDWLKTSLEFAMNDDEIRPELIEYLKNLIDGYR

SEQ ID NO: 7742 - protein, 488 aa, Palmaria palmata
MSQSVEQRTRIKNERYESGVIPYAKMGYWDPEHVILETDVLALFRVTPQPGVDPIEASAAIAGESSTATWTVVWTDLLTACDLYRAKCYKVDAVPNTSDQYFAYIAYDIDLFEEGSIANLTASIIGNVFGFKAVKALRLEDMRLPVAYLKTFQGPATGTVVERERMDKFGRPFLGATVKPKLGLSGKNYGRVVYEGLKGGLDFLKDDENINSQPFMRYSERYLYSMEGVNRAQAAAGEIKGHYLNVTAATMENMYERAEFAQQLGSVICMIDLVIGYSAIQSMAIWARKTDMILHLHRAGNSTYSRQKIHGMNFRVICKWMRMAGVDHIHAGTVVGKLEGDPVMIQGFYNTLLESHLEANLPQGIFFEQDWASLRKCTPVASGGIHCGQMHQLLDYLGDDVVLQFGGGTIGHPDGIQAGATANRVALESMVIARNEGRDFVAEGPQILRDAAKTCGPLQTALDLWKDISFNYTSTDTADFVETPTANV

SEQ ID NO: 7743 - protein, 223 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSCHHQQENVYENIAKRFDGVVSASYEDKPKQELAQNDVLMATTNDPSHYYGNNALWVHDDDFELSSLFTRNDEFCFW

SEQ ID NO: 7744 - protein, 233 aa, Zea mays
  unsure (1)..(233): unsure at all Xaa locations
MSTYLKKPPPCSVSLIVLLPLTLILLCFTFLLPLSAYISNPLASTAVATRACVGATAGVVRAAPATTTVGDVDGVVGSQRPAELMSVLVGVHTMPGKHSRRHLIRMAYALQQQTPALRAAARVDVRFVLCARPMPPEHRAFVALEARAYGDVLVLDCAENAEEGKTYTYFASLPTMLGSGSGGRPYDYVMKVDDDTFLQLDALVDTLRSAPRXDMYCGVGLPFHDRQFPPFML

SEQ ID NO: 7745 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 7746 - protein, 227 aa, Nothotsuga longibracteata
NKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPLKHFGMTEAGKKCGILGLGGVGHMGVKIAKAFGLHVTVISSSDKKKEEALEVLHADAYLVSKDAEKMQEAAESLDYILDTIPVAHP

SEQ ID NO: 7747 - protein, 354 aa, Streptomyces rochei
MKALILSGGTGSRLRPFTHSTAKQLLPVANKPVLVHCLENIRDAGVTEAALVVGAHAAEISGVVGDGSAFGLDLTYLHQDRPLGLAHCVQLAGDFLGDDDFVMYLADNVLADGIGKAARAFAAERADALLLVQPVADPRAYGVVEVGAGGHVRRLVEKPAEPAGDLAALGVYFFTSRIHEAVAGLRPSARGELEITDAIQRLVEDGAPVRAERYDGYWKDTGRAEDLLDCNRELLARLTGPAVHGEVDGTSTLSGPVVIEPGARVHGSHLKGPLVIAAGSTVTNCTVGPYVSVGRDCVLRDTVVADSILLEGAAVDGVPGLDHSIIGRWARIGRSAASGHQLLVGDHANAEVAA

SEQ ID NO: 7748 - protein, 335 aa, Azotobacter vinelandii
MKTQNKDLPGWLLAAGLGLAAPFGMAVQDEVTPAQVVAALEDTFGVTPGERRNHIKGTCASGEFVGLPAVAAWSRSALFSGQPVPVVARFSLPGGNPKVPDTARSVRGMALEFRLPGGALQHMTMLDTPVFGAAQPKTFLDQILALKPDPATGKPDPAKLAAFRASHPDSRAQARFLAEHNPPPSFANSSYFGIHTFKFVDATGKATLVRWRFVPEDGEKSLSDEELETLPADFLEERLIQRTAQGPVRWDMLVSIGQPGDPENDPTVAWPENREQVKAGTLVLTAAMPQKGAACEKVNFDPLVMAEGIAPTDDPILRFRSPAYAVSFAKRQAGQ

SEQ ID NO: 7749 - protein, 81 aa, Zea mays
  unsure (1)..(81): unsure at all Xaa locations
VIFDFPKPGIMFQDITTLLLDPKASRDTMDLFVERYMHQRXTVVAGVEAXGGIFGSPIALAIGAKYVPLREPRWLPGEVIY

SEQ ID NO: 7750 - protein, 354 aa, Agrobacterium tumefaciens
MPALANLNIVPFISVENMMDLAVSTGIENFLVQLAGYIEEDFRRWESFDKIPRIASHSRDGVIELMPTSDGTLYGFKYVNGHPKNTKSGRQTVTAFGVLSDVDSGYPLLLSEMTILTALRTAATSAIAAKYLARKDSRTMALIGNGAQSEFQALAFKALIGVDRIRLYDIDPEATARCSRNLQRFGFQIEACTSAEQAVEGADIITTATADKHNATILSDNMIGPGVHINGVGGDCPGKTEMHRDILLRSDIFVEFPPQTRIEGEIQQLAPDHPVTELWRVMTGQDVGRKSDKQITLFDSVGFAIEDFSALRYVRDRVEGSSHSSPLDLLADPDEPRDLFGMLLRRQAFRRLGG

SEQ ID NO: 7751 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 7752 - protein, 431 aa, Clostridium perfringens str. 13 [sequence omitted]

SEQ ID NO: 7753 - protein, 413 aa, Oryza sativa
  unsure (1)..(413): unsure at all Xaa locations
MGAIGEWRRGPVIGRGATATVSIATDRRTGGVFAVKSVDVARAGAPRREXGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGETERGAVAVAATVPLMAKSSEITGVERSIESRVASGSG

SEQ ID NO: 7754 - protein, 330 aa, Agrobacterium tumefaciens str. C58 (U. Washington)
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSPLKALGEKHGLI

SEQ ID NO: 7755 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIESGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 7756 - protein, 488 aa, Chordaria chordaeformis
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENFNSQPFMPWKERFLYWMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWPALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 7757 - protein, 375 aa, Xanthomonas axonopodis pv. citri str. 306
MLTLVLVVILAALVFEFINGFHDTANSIATVVATKVLSPGWAVMLAAGMNLIGALTGTAVALTIASGLLNTNVVEVTPQVILCALLGGIIWNLITWWKGLPSSSSHALIGGLCGAGLAAAHNDWDALIWSENIGNWAKNKGLLWKVFVPMITSPIAGFVLGIVVMVLLWAIIAGMSKIGGPIGRLARPRWVNAFFGKAQIASAAYMGYAHGHNDAQKTMGIIAMTLIGAQSAGALDDLPSWLSFLHPGTGLAAGAGIPMWIVLTCAVVMAAGTASGGWKIIKTLGHKMVKLHPIHGFAAETSSATVLTVAAHFGMPVSTTHSISTAIMGVGFAKNPRSLRLGVIERIVWAWILTIPAAGGVAYLILTLFELLGWT

SEQ ID NO: 7758 - protein, 200 aa, Zea mays
FSLRPGLQEASTSHQYMGELGLNFEVYRNDELTIEDVRRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEQETFPHDALEATAWTEDGLIMAARHKKYKHIQGVQFHPESIITPEGKKIILNFVRFIEELEKQRS

SEQ ID NO: 7759 - protein, 493 aa, Pseudomonas syringae pv. syringae B728a
MSLTRFQMCIDGQWVDALSGKTFDSLDPALAEPWAQLPDADEADVERAVQAAQKAFEGQAWRGLTATARGKLLRKLGDLIAENKEQLAQLESRDNGKLIRETRGQVGYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPQDEGTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 7760 - protein, 393 aa, Triticum aestivum
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 7761 - protein, 514 aa, Oryza sativa
MQFMMPLDTNACAQPMRRAGEGAGTERLMERLNIGGMTQEKALRKRCFGDGVTGTARRVFTSDADRDTPHLRTQFSRKNYADASHVSAVILGGGTGVQLFPLTRTRATPAVPVGGCYRLIDIPMSNCFNSGINKNIFVMTQFNLTSLNRNIHHTYLVGGINLTDGSVQVLAATQMPDEPAGWFQGTADAIRKFMWILEDHIHKSIDNIVILCGDQLYRMNYMELVQKHVDTNADITISCAPIDGSRASDYGLVKFDHSGRVIQFLEKPEGADLESMVDTSFLSYAIDDKQKYPYIASMGIYVLKKDVLLDILKSKYAHLQDFGSEILPRALLEHNVKVACVFTEYWEDIGTIKSFFDANLALTEQPPKFEFYDPKTPFFTSPRYLPPARLDKCKCKIKDAIISDGCSFSECTIEHSVIGISSRVSSGCELKIYETEEETSKLLFEGKVPIGIGQNTKIRNCIIDMNARIGRNAIIANTQGVQESDHPEEGYIRSGIVVILKNATNATIKHGTVI

SEQ ID NO: 7762 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSD

SEQ ID NO: 7763 - protein, 483 aa, Oryza sativa
ENKKEGPQESCNYCKLIGREGQSKKKKKEGQKKSKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTGRGSLKMSCAKPCAEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVELNKENAEACNFQ

SEQ ID NO: 7764 - protein, 230 aa, Lotus corniculatus
MTVAGYLNIGDFIPPLEWLDLQGVQGKMKKLHNRFDAFFAHIIEEQKVILKSEKHQDLLSTLLSLKEAPEDGDKLNDTEIKALLLNLFTAGTDTSSSTAEWAIAELIKNPRIMGQVQQELDNVVGKDKLVTELDMPNLPYLEAVVKETFRLHPSTPLSLPRAAAKSCEVFDYHIPKGATLLVNVWAISRDPKEWASPLEFRPERFLPGGEKASVDVRGTDFALIPFGAGR

SEQ ID NO: 7765 - protein, 156 aa, Triticum aestivum
  unsure (1)..(156): unsure at all Xaa locations
IMIEYPYVECTSSVIQGLVLFKEMYPKHIRLEEIDSCIQKAADYIESIQWSDGSWYGCWAICFTYGTWFGVRGLVAARRTXXNXLTIXKACEFLLSKXLLPSGGGGESYLSXQDKGYTNLXXNKXQAIXTNWAQLGPNXAXQXXKXSASLKXXXXF

SEQ ID NO: 7766 - protein, 187 aa, Glycine max
MSDTEDHAASEYSNGDESPPKPRQRFRDRSKEMLSKQAVQTKQMLSKQAVKIAKQAEEHERFINKVTHLVGVLGFGGFCFLLGARPQDIPYVYCLFYVIFVPLRWIYYRFKKWHYYLLDFCYYANTIFLVDLLFYSSNEKLFMVCFSFAEGPLAWALIVWRCSLVISSVDKIVSVLIQSSIDNRDGK

SEQ ID NO: 7767 - protein, 460 aa, Chondracanthus harveyanus
  unsure (1)..(460): unsure at all Xaa locations
WDPDYVVKDTDVLALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRAIAAAGETKGHYLNITAATXXXXXXXXEFAKQLGSIIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGPQILQDAAKTCGPLQTALDLWKDITFNYTSTDTADFVRNSTANV

SEQ ID NO: 7768 - protein, 174 aa, Triticum aestivum
  unsure (1)..(174): unsure at all Xaa locations
YTYIVHPWAPTVMASSATSVAPFQGLKSTAGLPVSRRSTALASAASASVXRIRCMQVWGGEGIKKFETLSYLPPVSTEALLKQVDYLIRSKWVPCLEFSKVGFIFREHNASPGYYDGRYWTMWKLPMFGCTDATQVINEVEEVKKEYPDAFVRFIGFDNLRQVQGRRFLAFKPP

SEQ ID NO: 7769 - protein, 63 aa, Brassica rapa
MRGILVDWLVEVAEEYTLVPDTLYLTVYLIDWFLNGNYVERNRLQLLGVTCMLIASKYEEIYP

SEQ ID NO: 7770 - protein, 176 aa, Triticum aestivum
  unsure (1)..(176): unsure at all Xaa locations
MAPTVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGXYYDGRYWTMWKLPMFGCTDATQVINEVEEVKKEYPDAYVRIIGFDNMRQVQCVSFIAFKPPGCEESGKA

SEQ ID NO: 7771 - protein, 757 aa, Zea mays
MWRLRIAEGGGDPWLRTKNAHVGRQVWEFDASADPDPAVDAARRAFAGSRGHLKHSADLLMRIQFAKENPLELDLPAIKLGEHEDVTEEAVSTTLRRAISRLSTLQAHDGHWPGDYGGPMFLMPGLIITLYVTGALNTVLSSEHQKEIRRYLYNHQNEDGGWGLHIEGPSTMFGSALTYVTLRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLVLELRKELFKDPYSKIDWDKARNLCAKEDLYYPHPFVQDVLWATLHKFVEPVMMSWPGSKLREKALETAMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDSCISKAANFIESIQKSDGSWYGSWAVCFTYGTWFGVKGLIAAGRTFESSPAIRKACGFLLSKELPSGGWGESYLSSQDQVYTNLKGNRAHAANTGWAMLALIDAGQAQRDPAPLHRAARVLINLQSEDGEFPQQEIIGVFNKNCMISYSQYRNTFPIWALGEYRCRVLGAGKR

SEQ ID NO: 7772 - protein, 375 aa, Bifidobacterium longum DJO10A
MTENTHHDPAALDKLAEPFTVLPNDNPASDEKRQSLIDKPAFGQVFSDNMTHMTWTKGEGWSDRRVEPYAPLKMDPGASVLHYAQECFEGLKAYRHADGSTWLFRPDANAERFQNSAKRLYLPELPIDDFLGSVAALVKRDANWVPSRREYTLYMRPFMFASEPFLGVRAPQEVDYCVIASPSGPYFPGGVKPVSIWVEDKWFRTGPGGTGFAKCGGNYAASLLGEYKGVENGCEQVCFVDAATKTYLEELGGMNMMAVHKDGHVETPSLTGNILPGVTRRSLIQLLQDKGHDVVETMIALDQLLEDIKSGEVTEVFACGTAAIITPIGRFKSEKFDVTVADGGSGKLTCELRDELLGIQLGEVEDPHNWMWKVC

SEQ ID NO: 7773 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 7774 - protein, 476 aa, Bradyrhizobium japonicum USDA 110
MVAKCTTAEDLVKAITDEKVQMIDLRFTDLPGVWQHFSVPPSAVNADALNEGIGFDGSSIRGFQEIQESDMLVVADPTTAFVDPYSPAKTLVLICNIRDPVTGQSYSRDARYIAQKAEIHLKGTGRADTSYFGPEAEFFVFDEVRYAQGINYAMHAVDSSEGSWNTGSEEGPNLGHKPRPKEGYFPVPPTDSMQALRTEMVLTMESLGIQIEAHHHEVATGGQNEIDMRFTTLTRMADNLMIYKYVVKNTAHQHGKTATFMPKPLFEDNASGMHVHQSLWKGETNLFYDKGDYAELSQLGRYYIGGLLSHAWALCGLCAPTTNSYRRLVPGYEAPINLVYSQRNRSACCRIPMYSPNPRAKRVEFRSPDPSCNPYLAFAAMLMAGLDGIDKQIDPGSPIDKNLYDLPPTEAKEVKSTPGSLDQALDALERDHAFLLRGDVFTADVIETWLDYKRKKEVDPIRLRPHPYEFHLYYDI

SEQ ID NO: 7775 - protein, 367 aa, Synechocystis sp. PCC 6803
MGEALNKGIYCPFDRNCAMVSIRPSVRHTPAYVPGEQPQTNDFIKLNTNENPYDPPAQVLAAVAAELPKVRLYPDPVSTQLRQAAADLYGVDLNQVLAGNGSDDILNIVVRTFVDPGETVAFLDLTYSLYETIASVHGAKVQKIATDANFDLTGPVICPEAKLIFLASPNPPKGKHLNREFLWQTCAQAEGVVVIDEAYGDFSDEDHWDFLQEFDNVIISRTLSKSYSLAGMRVGLAIAAPALIEEMDKVRDSYNLDRLAQVLGTAALRNQAEFVPLWEKVRHTRTRLMEQLAELDFQVCPSDANFVFAAPRWMAAADLYQALKEKKILVRYFNHPRITDYLRITVGTDGEIDQLLLAIASLKGSLG

SEQ ID NO: 7776 - protein, 238 aa, Zea mays
  unsure (1)..(238): unsure at all Xaa locations
LEAGREEIPLHCEIPTFNQSQYPRVVTEDFVSLPSXKANLGKDGXWHPSMDSGDXFPIFRITAGKLDILLAQDEEXMSFGAHSHTLRGIVDIKILNHLINIRTPYCMDATPKTRXADLNGGTLISYKRKDQFLDIAQVPXDHVNEFKSXIEKFNIFNTNNSWVNLYPINRLRKAEALEMEIIPNLQEADGGKVLQLKTXCDAAIQTFEQYILQLMLPSQCCSQMKATSDLMLVHADLN

SEQ ID NO: 7777 - protein, 694 aa, Rhodobacter sphaeroides
MSDYGAGGEFHQHAGEGDERLTTAQGVTIADNQNSLRSGAPGPTALEDFILREKIFHFDHERIPERVVHARGFGAHGLFECTKAIPEITRAAPFQKEGKITETFVRFSTVAGSKGSVDLARDVRGFAVKFYTDEGNWDLVGNNIPVFFIQDAIKFPDLIHSVKPEPDRGFPQAQSAHDNFWDFISLTPESMHMVMWQMSDRAIPRSFRFMEGFGVHTFRFINAEGQSSFVKFHWKPKLGMQSVLWDEALKINGADPDRHRRDLWEAITAGDFPEWELGLQIFDEEFANRFDFDVLDPTKIIPEELVPLTIVGTLTLDRVVDNFFAETEQVAFCTQNVVPGIDFTDDPLLQGRNFSYLDTQLKRLGSPNFTKLPINAPRGCPVHNFQQDGHMQTSNRKGRVNYEPNGWGKGPRAHPLEGYVSYAVRNEGEKRRLRPESFADHYSQARQFFLSQTPVEQGHIRDALVFELSKCQEIEIRARIVAHLLNIDGALAQAVADGLGLTEMPEPAPAARPTRTDLPPSDALSMLKNPPPNFAGRTVGVLAGNGVEAELLTELRSILQAEGAMMKLVAPRVGGVTDSAGTLHPADEKLGGGPSVIFDAVAVLPGSDAAMLAANPAAQDFLTDAHAHCKFIAHHGAGPLIEACALGAKMDEGWIEIGSSSDIDGFVAACRGMRHWPREATLGGNPPLARTFSP

SEQ ID NO: 7778 - protein, 189 aa, Prochlorococcus marinus subsp. marinus str. CCMP1375
MIVLTLINNLSIHEVTPTLQRAEIIAALTSISIILVGFLQLDENPIKKSNSNLVGFEGFIINEDLSFEVRNELAWGTQMILTATASCTVLIYNNNQTILKRGLLSETEFSPGTICLSSTKKGKYISLVNTKFYPGKVEFDSIIKDLPSIMVFPIKSNSWLIVGGWSERCFTKSDEVWIDGWSKKISKML

SEQ ID NO: 7779 - protein, 196 aa, Mitthyridium sp. Wall 2991
GGAKKVVISAPSKDAPMFVMGVNEDKYTNEDVVSNASCTTNCLAPLAKVINDKFGILEGLMTTVHATTATQKTVDGPSNKDWRGGRSASTNIIPSATGAAKAVGKVLPELNGKLTGMAFRVPTTDVSVVDLTVRLEKPASYDAIKAALKEASQGKMKGILGYTEDEVVSSDFITDSRSSIFDAKAGIALSDTFVKL

SEQ ID NO: 7780 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYREHNSSPGYYDGRYWTMWKLPMFGCTDGTQVLAEVQEAKNAYPQAWIRIIGFDNVRQVQCISFIAYKPEGY

SEQ ID NO: 7781 - protein, 214 aa, Clostridium thermocellum ATCC 27405
  unsure (1)..(214): unsure at all Xaa locations
MIENILIIDNYDSFTYNLYQYVGEISPNIEVYRNDKITLEKIEEMNPTHIIISPGPGFPKDAGICIEAIRKFGRYIPILGVCLGHQAIGEAFGGKVVHAKELMHGKASEVEIDRECLIFRNLPEKIRVGRYHSLIVQKEGLPECLKITAVTQDGEIMGLMHKSFPVFGXXXXXXXXXXXXXXXXXXXXXXXXEGKAILKNFINIKRVNIKRVAI

SEQ ID NO: 7782 - protein, 241 aa, Triticum aestivum
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAAAASSSGSGEAAVSAGGGKVHECNVCRKTFPTGQALGGHKRCHYDGTIGSAAAGPAQKLAAKAAAASATAASQGFDLNLPALPDIPERCAVTEDGEEVLSPASFKKPRLMLAA

SEQ ID NO: 7783 - protein, 241 aa, Oryza sativa
MFGKGHDLEAGGSSEPLYPGMVESPDLRWALIHKIYVILSVQLAMTAAVAAFVVKVRGVSEFFVSSNAGFALYIFLLFLPLIVLCPLRYYHQKHPVNLLLLGLFTVAISFAVGMTCAYTSGKVIFEAAALTAVVVISLTAYTFWAAKRGHDFNFLGPFLFSAVMVLILFSLIQIFFPLGKISEMIYGGLASLVFSGYIIYDTDNIIKRYTYDEYVWAAVSLYLDVINLFLALLRVLRAADN

SEQ ID NO: 7784 - protein, 128 aa, Triticum aestivum
MASNSSAAAAAAFFGMRDGDQQDQMKPLLSQQQQQHQQQLAAVALSGVGSAAPAASSQGAPAAAPPAKKKRTLPDPDAEVIALSPKTLMATNRFVCEVCNKGFQREQNLQLHRRGHNLPWKLKQKNPN

SEQ ID NO: 7785 - protein, 102 aa, Glycine max
  unsure (1)..(102): unsure at all Xaa locations
PNFSYSLAISAANLERQACKDEXTDAEKASPSDLMKQALTLHPSITKKLVAKAPSKDHTPTDILKHTFFRTHQTRDPSQEHSINIYSERKYLKXRLPDLQKL

SEQ ID NO: 7786 - protein, 116 aa, Bacillus circulans
EFRTPDSTANPYLAFSAMLMAGLDGIKRKIDPVALGYGPFDKNIYELSDAEKKEIRSVPGSLDEALDALQADYEFLTEGGVFTKEFLDNFIEFKRAEAKDISIRTHPHEYSLYFDI

SEQ ID NO: 7787 - protein, 332 aa, Listeria monocytogenes
MTLKEAGLTEDKLIKMYETMLMARRLDERMWLLNRSGKIPFTISGQGQETAQIGAAFAFDLDKDYALPYYRDLAVVLAFGMTAKDIMLSAFAKAEDPNSGGRQMPAHFGQKSNRIVTQSSPVTTQFPHAAGIGLAAKMAGDEIAIYASTGEGSSNQGDFHEGINFASVHKLPVVFVIHNNQYAISVPASKQYAAEKLSDRAIGYGIPRERVDGTNMGEVYAAFKRAADRARNGEGPTLIETVSYRFTPHSSDDDDSSYRSREEVNEAKGKDPLTIFQTELLEERLLKTEEKIAEIEKNIAKEVNEATDYAESAAYAEPESSLLYVYDEEANS

SEQ ID NO: 7788 - protein, 572 aa, Escherichia coli CFT073
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATTHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKTDRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVMQMKLPVKIIVFNNSVLGFVAMEMKAGGYLTDGTELHDTNFARIAEACGITGIRVEKASEIDEALQRAFSIDGPVLVDVVVAKEELAIPPQIKLEQAKGFSLYMLRAIISGRGDEVIELAKTNWLR

SEQ ID NO: 7789 - protein, 404 aa, Haemophilus somnus 2336
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 7790 - protein, 175 aa, Draba nemorosa var. hebecarpa
MVRGKTQMKRIENATSRQVTFSKRRNGLLKKAFELSVLCDAEVSLIIFSPKGKLYEFASSNMQDTIDRYLRHTKDRISSKPVSEENMQHLKHEAANMMKKIEQLEASKRKLLGEGIGTCSIEELQQIEQQLGKSVKCIRARKTQVFKEQIEQLKQKEKALAAENEKLSEKWGSNE

SEQ ID NO: 7791 - protein, 445 aa, Oenococcus oeni MCW
EGGIYMTSKKGSDLLVSVLTDWGIKEVYGLPGDSVDTTVDALRRQKDKIKFIQVRHEEVASLAASASAKYTGKIGVCLSIGGPGAIHLLNGLYDAKMDHVPVLALLGQVTSQSLNEGYFQEVNTPKLFDDVAVFNRTISSVDNLAEIVDQAIRSAYENKGVAVLTIPDDIPDQELKTIYHSSAKAFSLAKPSINEEQINKASELIKNSQKPIALIGLGAKESGEEVTSFLEKNNIPFVQTLPAKGTISDDHPNSLGNVGKLGTKPAYEAMKNADLLILLGSNYPYLPYLPNKGQAKCIQVDLKAENLGKRYSVTTAIQADVYDVVHALNKKGVLRDNKSFLQACQKNMDNWNKWMQEKRELDTTPISPESMVAYIDQTAPDDLVYSIDVGTSTSWAARFLHVKRNQKFAISAWLGTMGCGLPGAIAGQIVFPKRRVLSLIGDGAF

SEQ ID NO: 7792 - protein, 81 aa, Triticum aestivum
  unsure (1)..(81): unsure at all Xaa locations
MVVTIHSVKAGQIFDSRGNPTVEVDVCCSDGTFARAAVPSGASTGVYEALDLRDGGSDYLGXVLLKAVAIVNLIIGPVLIG

SEQ ID NO: 7793 - protein, 187 aa, Magnetospirillum magnetotacticum
MGGDIVPAFVEKGTAAVYDFIRNDVPGSTDRDRDYWRDVGTIDSYYDANKDLIAVTPVFNLYNEEWPLHTGYTGLPPAKFVHAGRGRLGHAADSIVSPGVIISGATAVGSVLSPGTYLHSWSSVSDSVLMDGVQVHRHAQVHRAIIDKNVVVGEQARIGLDPEQDRARGFTVTESGITVVPKGTVVE

SEQ ID NO: 7794 - protein, 337 aa, Oryza sativa
MEQQLPLLAPDSKAATSSPLCLTLDNPTSTSTSPAVPSSAPPPAAALEPSRQSFHERETDAIKAKIMSHPLYPALLRAFIDCQKVGAPPEVVGRLSALAGELDSRAEDRYLQGQSSDPELDEFMETYIDMLVSYRQELTRPIQEADQFFRNMEAQIDSFTLDDNGSEGGNSSEDEQEAGGGDMASAGLPEITSPCAEDKELKSHLLNKYSGYLSSLWRELSKKKKKGKLPRDARQKLLHWWQLHYRWPYPSELEKAALAESTGLDAKQINNWFINQRKRHWKPTPPAMEYRSLQPAGAASYGGASAGASTSGGGSAVVRGMEGQHFTGGGAYPRGDP

SEQ ID NO: 7795 - protein, 341 aa, Oryza sativa
MESFASLAGGGSSSTTARLPELISPENPDHISPPPLLYQLLAGPESSARQHGHDGHHHGGGGGEAAAAAVQGQVSPAGAEAAVKAEIMSHPQYSALLAAYLGCKKVGAPPDVLTKLTAVPAAQQLDEADGHPRRRHEPQRDDDPDQLDQFMDAYCSMLTRYREELERPILEAAEFFSRVETQLDSLAESNCEGTGSSEEEQDPSDKQLKHQLLRKYGGSLGDLRQVFSKRTKKGKLPKEARQKLLHWWELHYKWPYPSEMEKMTLAQTTGLDQKQINNWFINQRKRHWKPTPVAGTAFPTMEAAGGGFRHSGHGGGLAAAAALPLYMGRPFVVDGMYRLGS

SEQ ID NO: 7796 - protein, 376 aa, Schizosaccharomyces pombe
IMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHHHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSMVVGATNFVFTIVAFMFIDRIGRRRILLCTSAVMIAGLALCAIAYHFLPADTTQNTHSGWQYVVIASIIIFLASYASGIGNIPWQQAELFPMEVRALGAGFSTAINWVGNLIISASFLTMMESITPTGTFALFAGFCFVGLVTSYFTYPELAGMFIENIHKLLEKGFWQA

SEQ ID NO: 7797 - protein, 432 aa, Myxococcus xanthus
  unsure (1)..(432): unsure at all Xaa locations
MAPPSSGEKISLQSGKLSVPDNPIIPFIEGDGTGRDIWRASQAVFDAAVEKAYKGKKKIAWYEVLAGEKSFKAVNNWLPEETVEAFRTYLVGIKGPLTTPVGGGIRSLNVALRQMLDLYVCLRPVRYFKGVPSPVKMPDKVDMTIFRENTEDIYAGIEFEAGTAAAEKFLGLLKQEFPKEFGKIRFPSDVGLGIKPVSHEGSDRLIRAAIQYAVDHKRKSVTLVHKGNIMKFTEGAFRKWGYELAAREFGDKVYTWDQWEATKAXKGEDAANAEQKAALAAGKILIKDSIADITLQQVLTRPDEFDVIATLNLNGDYLSDALXAQVGGIGIAPGGNINYVTGHAVFEATHGTAPKYADQDKVNPGSVILSGEMMFRHLGWYEAADLMIQGMDRAIASKTVTYDFARLMKQEGQSGVSEVKCSEFGQAIIKNM

SEQ ID NO: 7798 - protein, 465 aa, Candida albicans
MFPNSPDAFHQVRMMQSSIKASNFKLQSMEFRCHSNNVCEYQMEMLHHLLSVEAKTLPSLSLIEQQPEIKLGMRPLLLDFLMEVITILNLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 7799 - protein, 464 aa, Lophocladia trichoclados
  unsure (1)..(464): unsure at all Xaa locations
KMGYWDPNYAVKETDVLALFRVTPQPGVDPIEASAAVAGESSTATWTVVWTDLLTACDLYRAKAYKVDAVPNSTEQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEGVNRSIAGTGXVKGHYINVTAATXXHMYERAXFAKQLGTVIIMIDLVIGYTAIQTMGIWARQNDMILHLHRAGNSTYSRXXIHGMNFRVICKWMRMAGVDHIHAGTVVGKLEGDPLMIRGFYNTLLEPYLAIDLPKGIFFEQDWASLRKVTPVASGGIHCGQMHQLVDYLGNDVVLQFGGGQIGHPDGIQAGATANRVALEAMVXXXXXXXXXXXXXPQILXNAAKTCGPLQTALDLWKDITFNYTSTDTADLVETPTANV

SEQ ID NO: 7800 - protein, 106 aa, Triticum aestivum
  unsure (1)..(106): unsure at all Xaa locations
MAPTVMASXAXFVXPXQGLKSTXXXPXSRXSNXASLXSXSNGGRIRCMQVWPIEGIKKFETLXYLPPLXNGGXFLKHVDYLIRSKWPXCLXFIPGSXFXFPLPFLL

SEQ ID NO: 7801 - protein, 625 aa, GIBBERELLA ZEAE PH-1
MLSHPENTDLIVPYLYQLDMVAGLLAVGNQIMALLAWQHQWDHQNGVSNTLRRLSHTPFAMSPFTVGDYLAERIAQIDIRHHFIVPGDYNLILLDKLGGHPSLTEIGCTNELNCSLAAEGYARGHGVSVCIVTYSVGAFSAFNGIGSAYAENLPVILISGSPNTNDVSQHILHHTLGIYDTTYQLEMAKKITCCAVRIRQAAHAPELIDRAIRAALTQRKPVYIEVPTNLAGETCPRPGPISSVISAVPSDRHSLDVAVTKTAEYIGSKQKCVVLVGPKVRRAMAQDALRQFVEAIGSAVVLQPAAKGTFPEDHAQFCGIFWGQVSTLAADTIVNWADLIICIGAIFTDYSTVGWTALPSVPQLFVDLESVTVASKIYCSRVQMSEFLSRLAETVCWNDNTMVEYNRLRPDPTLGEPSCGPERLTRKEITRQTQALISLNPQTVIFADTGDSWFNGLKLNLPFGADFEIEMQWGHIGWSIPASFGYALAKPHKRIVVMVGDGAFQMTAQEVSQMVRFRVPIIILLMNNKGYTIEVEIHDGSYNCVQNWDYARLVQAFSTENGNGHALGLEARTAEELSNSLERAIVHTNGPTLIDCSLHRDDCSRELITWGHFVAAANARMPKKE

SEQ ID NO: 7802 - protein, 489 aa, Pseudomonas aeruginosa PAO1
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWIIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVTATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 7803 - protein, 253 aa, Zea mays; identical to SEQ ID NO: 3990

SEQ ID NO: 7804 - protein, 459 aa, Bacillus anthracis str. Ames
MGENHDKQRQSLLGKDFNENGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVHLYSDNGTAKSFRRIPGHSVNTYVWRNAEGNRKYVKYHWYPFEGVQSITNEEANKLAAENPDYSGKDLYDAIANGKPVEYGLYVQLMDPKDEAHLSYDPLDDTKAWDEKAYPLIPVGKMVLNKNPENYMEQVEKVAFSPSNLLNGAELSDDKMLQGRANIYSDSQRRRIGPEFRKLAINQQQDWTPANQITSGDGRYVEGKLERTSIPKQDDFTQAGEFYAKLQPIEKEHLAENLASDLKVISDDIRKVVLGYFHNVSADLVKRIESAMQQL

SEQ ID NO: 7805 - protein, 183 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 7806 - protein, 729 aa, Saccharomyces cerevisiae
MFYNRWLGTWLAMSALIRISVSLPSSEEYKVAYELLPGLSEVPDPSNIPQMHAGHIPLRSEDADEQDSSDLEYFFWKFTNNDSNGNVDRPLIIWLNGGPGCSSMDGALVESGPFRVNSDGKLYLNEGSWISKGDLLFIDQPTGTGFSVEQNKDEGKIDKNKFDEDLEDVTKHFMDFLENYFKIFPEDLTRKIILSGESYAGQYIPFFANAILNHNKFSKIDGDTYDLKALLIGNGWIDPNTQSLSYLPFAMEKKLIDESNPNFKHLTNAHENCQNLINSASTDEAAHFSYQECENILNLLLSYTRESSQKGTADCLNMYNFNLKDSYPSCGMNWPKDISFVSKFFSTPGVIDSLHLDSDKIDHWKECTNSVGTKLSNPISKPSIHLLPGLLESGIEIVLFNGDKDLICNNKGVLDTIDNLKWGGIKGFSDDAVSFDWIHKSKSTDDSEEFSGYVKYDRNLTFVSVYNASHMVPFDKSLVSRGIVDIYSNDVMIIDNNGKNVMITTDDDSDQDATTESGDKPKENLEEEEQEAQNEEGKEKEGNKDKDGDDDNDNDDDDEDDHNSEGDDDDDDDDDEDDNNEKQSNQGLEDSRHKSSEYEQEEEEVEEFAEEISMYKHKAVVVTIVTFLIVVLGVYAYDRRVRRKARHTILVDPNNRQHDSPNKTVSWADDLESGLGAEDDLEQDEQLEGGAPISSTSNKAGSKLKTKKKKKYTSLPNTEIDESFEMTDF

SEQ ID NO: 7807 - protein, 461 aa, Xylella fastidiosa 9a5c
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 7808 - protein, 765 aa, Escherichia coli K12
MKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSTMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 7809 - protein, 472 aa, Gymnogongrus griffithsiae
ESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAASGETKGHYLNVTAATMEEMYERAEFAKQLGSIIVMIDLVIGYTAIQTMAVWARKNDMILHLHRAGNSTYSRQKIHGMNFRAICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 7810 - protein, 87 aa, Zea mays
VNQIGTVPESIQAALDSKAAGWGVMVSHRSGETEDNFIADLSVGLASGQIKTGAPCRSERLSKYNQLFRIEEELGNVRYAGEAFRSP

SEQ ID NO: 7811 - protein, 803 aa, Oryza sativa
MASRMALRPNDVTLRLTPPLAAAARRNRRAAAGGVRVYAVASGAVSTKVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKAVLLLSVLVETHFENNTRSDKVSGNMWTSLFALLTILISEINREYAIMLIRLLLGSPEPEKKKKMIGWGDVYKVVAATVPLYFALFLGYGSVRWWRIFTREQCDAVNRLVAFFALPFFTFEFTLHTDPFQVNYRAVAADVISKAVIVAVIGAWARFMSKGGCAVSWSITSFSLSTLTNSLVVGVPMARAMYGEWAQQLVVQLSVFQAIVWLTLLLFVLEVRKAAIGMYVDGAEAAAAAGKDVEAAGAAAAAGTVVVAAAAGKPSLWALVKVVAHKLARNPNTYASFVGITWACLANRLHIALPSAFEGSVLIMSKSGTGMAMFSMGLFMAQQEKIIACGTSFAALGLVLKFALGPAAMAIGSIAVGLRGDAALPQSITSFIFAKEYGLHADVLSTAVIFGMLVSLPLLVGFYIVLELIR

SEQ ID NO: 7812 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 7813 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 7814 - protein, 529 aa, Oryza sativa (japonica cultivar-group)
MAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQVYVPSMW

SEQ ID NO: 7815 - protein, 492 aa, Zea mays; identical to SEQ ID NO: 1824

SEQ ID NO: 7816 - protein, 502 aa, Candida glabrata
MSTAKKHTKTHSTYAFESNTNSVAASQMRNALNKLADSIGSEHGDDARTRFENELDSFFTLFRRYLVEKSSSNTLEWDKIKSPNPEEVVRYDTINSQAENVSSLSKLAVLKLNGGLGTSMGCVGPKSVIEVREGNSFLDLSVRQIEHLNRQYDSDVPLLLMNSFNTDKDTEHLIKKYSANRIRIRSFNQSRFPRVYKDSMLPVPETYNDPKDAWYPPGHGDLFESLHASGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLVESSALEMEIIPNQKTITRGGQEINVLQLETACGAAIRHLSGAHGVVVPRSRFLPVKTCSDLLLVKSDLFYLQHGALKLDPSRFGPNPLIKLGSHFKKVSDFSARIPHIPKLVELDHLTITGNVFLGKGVTLRGTVIIVCSDGQKIDIPNGSVLENVVITGNLQILEH

SEQ ID NO: 7817 - protein, 232 aa, Guillardia theta
MSFNIFLSPEGRLKDLEYAQEAANLGSTSCGIKTKDFIFILSERKKKKSLDYLNDQKIYVLDKNKGCCVSGLISDSRKIIDNVRIYCENKYFLINSYPSIEECSNLINNLITSYNTNNDVNKISPRPLGTSFLLFGKSNKKLELIKVDPSGRYIKDKILAIGEGSKDVLIILQEGYRSNMKKIEAKTLAFKTLRAISESILNEKNVEAAQISESNTLRILFKEEINQILKLI

SEQ ID NO: 7818 - protein, 172 aa, Glycine max
  unsure (1)..(172): unsure at all Xaa locations
PNQNHSLFSFFSVASQNGISSDYVQLSIALNKTNSSKMSTPLFHEFKRQASFFFKEKIKTARLALTDVTPAELMTXEEATSGNPWAPDARTLRSISRDAFELDDYWRIVEILHKRFLKFEKKNWRISYNSLIVLEHLLTHGPESVAEEFKSDKDVILDCISVYLICVEIQPS

SEQ ID NO: 7819 - protein, 492 aa, Solanum tuberosum
MDPSKYRPSSAYDTPFLTTNAGGPVYNNVSSLTVGPRGPVLLEDYYLIEKLATFDREKTPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 7820 - protein, 243 aa, Schizosaccharomyces pombe
MVLEATMILIDNSEWMINGDYIPTRFEAQKDTVHMIFNQKINDNPENMCGLMTIGDNSPQVLSTLTRDYGKFLSAMHDLPVRGNAKFGDGIQIAQLALKHRENKIQRQRIVAFVGSPIVEDEKNLIRLAKRMKKNNVAIDIIHIGELQNESALQHFIDAANSSDSCHLVSIPPSPQLLSDLVNQSPIGQGVVASQNQFEYGVDPNLDVELALALELSMAEERARQEVAAQKSSEETEDKKMQE

SEQ ID NO: 7821 - protein, 123 aa, Zea mays
SAPTQPEFRLLIGVLTRADLYERRHLLRMVYGLQLASPGGLAAHVDVRFVFCRLYKDDQRVLVPLEILAHGDVIVLDGCEENLNGGKTYTFLSAVAALYADEPYDYVMKADDDIFLRLPQGCR

SEQ ID NO: 7822 - protein, 393 aa, Bacteroides thetaiotaomicron VPI-5482
MQKESQTYKIAPAERLASVSEYYFSKKLKEVAQMNAEGKDVISLGIGSPDMPPSKVTIETLCNNAHDPNGHGYQPYVGIPELRKGFAAWYQRWYGVELNPNTEIQPLIGSKEGILHVTLAFVNPGEQVLVPNPGYPTYTSLSKILGAEVISYDLKEEDGWMPDFEALEKMDLNRVKLMWTNYPNMPTGANATPELYERLVDFARRKNIVIVNDNPYSFILNEKPISILSVPGAKECCIEFNSMSKSHNMPGWRIGMLASNAEFVQWILKVKSNIDSGMFRAMQLAAATALEAEADWYEGNNHNYRGRRHLAGEIMKTLGCTYDENQVGMFLWGKIPASCKDVEELTEKVLHQARVFITPGFIFGSNGARFIRISLCCKDAKLAEALERIKKLS

SEQ ID NO: 7823 - protein, 340 aa, Corynebacterium efficiens YS-314
MTTFRAALVESFDADIAVKDVERPTPGPNQALVKLIASGICHTDLHAAKGDWPVLPEPPFIPGHEGIGEIVELGPGEHDVAVGDIVGNAWLWSACANCEFCRTGRETFCPNAQYGGYTQNGSFGEYMLVDTRFAPRIPDGVDYLEAAPILCAGVTVYKALKVSNIRPGQFMVISGIGGLGHIAVQYAKAMGMRPIAVDIADSKLELAKSLGAEFTVNARDVDPAEAVREFTNGGAHGVLVTAVHEKAFGQALGMARTNGTIVFNGLPPGEFPVSVFDVVFRGLTITGSLVGTRQDMEEALDFYARGLIKPKVAECGLDDVADVFEKLESGGIDGRVAIRY

SEQ ID NO: 7824 - protein, 473 aa, Pleurochloris meiringensis
YESGVIPYAKMGYWDADYNVKHTDILALFRITPQPGVDPVEAAAAVAGESSTATWTVVWTDLLTACDIYRAKAYRVDPVPGTTDQFFAYIAYECELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGVNRAAASTGEVKGSYLNCTAGTMEEMYERAEYAKKTGTIIVMIDLVIGYTAIQSMAIWARKNDMILHLHRAGNSTYARQKNHGINFRVICKWMRMAGVDHIHAGTVVGKLEGDPLMVKGFYNTLLDTKLDINLPQGLFFEMDWAALRKVVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPDFVETATESR

SEQ ID NO: 7825 - protein, 302 aa, Heterosigma akashiwo
RIGRLVARSLIANPETDLKVINSGASNDYMAYQLKYDSVHGRYPGTVEIADDGLIIDGSLVPTMHTRDPGAVGWGKFGADYICESTGAFLTAEKCAPHLADGAKKIIFSAPAKDDSPTVVMGVNQDTYTTDMQFVSCASCTTNGLGPLVKCIDDAFGIEMGLMTTVHAMTATQLVVDGSSKGGKDWRGGRCASSNIIPSSTGAAKALTKVMPNLKGKLTGMAFRVPTPDVSVVDLTAVLQKEASYEDICAAVKARSEGDMAGILGYCDEPCVSQDFVSDPRSSIFDAEAGISLNPKFCKVVS

SEQ ID NO: 7826 - protein, 445 aa, Stenogramme interrupta
  unsure (1)..(445): unsure at all Xaa locations
FRVSPQPGVDPIEASAAVAGESSTATWTVVWTDLLTACDLYRAKAYKVDAVPRTDDQYFAYIAYDIDLFEEGSIANLTASIIGNVFGFKAVKALRLEDMRLPVAYLKTFQGPATGIVXERERMDKFGRPFLGATVKPKLGLSGKNYGRVVYEGLKGGLDFLKDDENINSQPFMRWKERYLYAMEAVNRSIAASGETKGHYLNVTAATMEEMYERAEFAKQLGSIIIMIDLVIGYTAIQTMGIWARRNDMILHLHRAGNSTYSRQKIHGMNFRVICKWMRMAGVDHIHAGTVVGKLEGDPLMIRGFYNTLLFSYLEVDLPKGIFFEQDWASLRKVTPVASGGIHCGQMHQLLDYLGVDVVLQFGGGTIGHPDGIQAGATANRVALETMVIARXEXRDYVAEGPQILQDAAKTCGPLQTSLDLWKDITFNYTSTDTADFVETPTANV

SEQ ID NO: 7827 - protein, 321 aa, Triticum aestivum
  unsure (1)..(321): unsure at all Xaa locations
FNLPAGLLSTSYLSHLPSISSYHNGWPIHGSTLGAFAFGLLGNIISFTSLLXPPIPTFYRIFKXKSTEGFQXSVPYVVALFSAMLWIFYALVKTGEGLLITINAAGCVIETIYIVMYLVYAPRKAKIFTAKIVLLLNIAGFGLIFLLTVFAFQGETRVISLGWICVGFSVCVFVAPLSIIGRVIKTKSVEYMPFSLSLTLTLSAIVWFLYGLLIKDKYVALPNXLGFTFGMIQMVLYMFYMNATPVVTSDVKEVKEAWKVPAEDQVVVINVGKADKSSCAEVRPVTEMASAVDVPRRCAAEAAAPRQQVMAVDFARSVEVV

SEQ ID NO: 7828 - protein, 304 aa, Chloroflexus aurantiacus
MTTTTTRVEQPVLFAGLTPTDLTMLLVVLIWGANFSIVKAALTEIPPLVFATLRFTSASVLLVGFMFWREGKRALPDRRTFWKLTWIGVVGNTIYQALFTYSLTMTTAANGSLIIATTPALVALAAALLGIERIRRVMAVGIALAISGVALVVAERGLSLGGQGLLGDLLMLGAAFCWMMYTLGVRTLGQGLSPLAITTWTMVTGVPGMILISLPDWSTVVWDQVSLQAWLALAYSTLLALVLAYVLWNNSVRVAGSARTAIYGCAIPLVATLIAWPLIGEQPTWVQGIGGLLIVSGVLLTRRP

SEQ ID NO: 7829 - protein, 341 aa, Actinosynnema pretiosum subsp. auranticum
MPRRLAEQVVVVVGASSGIGRVTALRFAAAGARVVCAARNTRALDGLVEEVRGAGGRAVAVTADIADEAAVRAVADVAVERFGRVDTWVNAAGIGVYGRVEDTPAGEFDRVMRVNYLGHVHGAKAALPALRRAGGGVLIGVASVLGLRSAPLQAPYAASKAAVRAFYDALRVELAHDGESIAVTAVLPAAINSPFFEHCRSRVGSLPKPPPPVYAPELVAEAVLRAAERPRREVPVGDAALAFYLGQRLFPALTDALMSVRAVGRSGMRSELPDNGVDNVDSPVDEDGRVHGSYPGRVLDSSPVTALLARVPRPGELATSLVSGAHRVGGAVRGGLRAARS

SEQ ID NO: 7830 - protein, 457 aa, Sphacella subtilissima
  unsure (1)..(457): unsure at all Xaa locations
DYNVKETDILALFRITPQPGVDPVEAAAAVAGESSTATXTAVWTDLLTACDIYRAKAYRVDPVPGTSDQFFAYVAYDCDLFEEGSLANLTASIIGNVFGFKAVKALRLEDMRIPFAYLKTFQGPATGVIVERERLDKFGRPFLGATVKPKLGLSGKNYGRVVYEGLRGGLDFLKDDENINSQPFMRWKERFLYCMEGVNRAAAATGEVKGSYLNVTAATIEQMYERAEFAESVGTVICMVDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEEVDYVANGPEILRVAAXTCGPXKAALDXWKDITFEYTSTDTPDFVEVATESK

SEQ ID NO: 7831 - protein, 498 aa, Asparagus officinalis
MPLILVILLLLPILLLVIRREKSTSSKLPPCPPKLPLIGNLHQLGSLPHQSLHALSVKYGPLMLLKLGEIPTLIVSSSDMAREIMRTHDHIFASRPSLLTSDILLNGATDVVFAPYGEHWRQMRKLCVNHLLSAKMVQSFRLMREEEVSSMLTRISGLVNMSEVLNLFTSKILFNAISGKFFVEEEGRINVFCKLIRENIAILAQLSVSDFFPSLGWLDLVFGVGARARATAKKWDDVLDEVIEDHVKRSNETGDADDQEERADFVSVLMALQEDDNTGFTLNRNIIKAILQDMIAAGTETSFLVLDWGMTELVRNPGTMKKLKDEVRSVAGSETVVREEDISKMFYLKAVIKEILRLHPPVPLLIPRESMDHCNVQQYEVPSKTRVLINAWSMGRDPKVWEDPEEFRPERFLDSDIDFRGQCFEFVPFGAGRRICPGMHFAAANLELALANLMYRFDWELPDGMKSEDLDMGDSPGLTTRRRQNLHLVARPFQRVKR

SEQ ID NO: 7832 - protein, 253 aa, Geobacillus stearothermophilus
MRKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 7833 - protein, 444 aa, Brassica rapa
MATITAVKARQIFDSRGNPTVEVDVHTSSGVKVTAAVPSGASTGIYEALELRDGGSDYLGKGVSKAVGNVNSIIGPASIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDNVQIVGDDLLVTNPKGVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 7834 - protein, 352 aa, Desulfitobacterium hafniense
MPKIAVLPGDGIGQEIIPQAVRVLKAVLAETDAEFEFQDYPIGGAAIELVGKALPDETLQGCREADAVLLGAVGGHQWDHLPASERPETAALLGLRKGLNFYANIRPVRMIPSLLATSTLKENVLDGVDMVVIRELTGGVYFGEKGRSDNPRSAYDKMTYSEEEIRRILIQGFETAMLRSKKLCSVDKANVLETSRLWREIANELAKEYPEVELTHMYVDNAAMQLVRNPKQFDVIVTENMFGDILTDLASMLGGSIGMLSSASLSGTQGMYEPAHGSAPDIAGKNLANPLATILSAALMLRYSFGMEAEALRIESAVEKVLEQGYRTGDLAQAGDKVVGTIEMGDAVLAAL

SEQ ID NO: 7835 - protein, 521 aa, Oryza sativa
MAARPCQAAARPGTASTRIREASRATTRAKEVRGRAVANGGGHGAACDKGKWFGGELTNEINGVGGADGVAARWTRRRGGAAPRVHGRGRREGEVAMGSLELLVTRPRTHWLLRCSVADGEGESGASNNNGAAVMEVKREKDSMGGARVFIAKARSGHRSMGSSSGSDRLRDLQALAGTKAGVKGLVDAGVTTIPAIFHRHPLLLDDAEEDADVIPVIDLQADVDRGHLVGQVRAAAQCVGFFQVVNHGIPGELLEEMLAAVRRFNEQPAEGKKAWYSRDSGRRVKFNSNFDLFQSPAANWRDTLLLELTPRPGPAAEEIPPACRGVVGEYVEAVQRLGGALLELLSEALGLPPEYLGGLGGGLATMAAHYYPPCPEPHLTLGTTRHSDPSFLTVLLQESKGLQVLMRQRQRWVDVPPVAGALVVNIGDLLQLVSNDLFRSVEHRVLATTAAAEPRLSVACFFRPDYACTRVYAPVTTTPPPPLYRSTTMPEFLSHYRAKGLDGRSALHHFRIPPPSSPPH

SEQ ID NO: 7836 - protein, 466 aa, Glycine max
  unsure (1)..(466): unsure at all Xaa locations
SDDSKKTRRTRKKGASSSAGLEEKKEVKEEKKVRRRKKTEEEKLIVEDKGSEAEISDQDEPSFLENVEDDSDSGLELIKDDGEDISFTYGWPPLVCCFGAVQHAFVPSGRPANRLINHEIHESMPDALWSPEKFVRAPGGSAGSVAIALATLGGKVAFMGKLADDDYGQAMLYYMNANNVQTRSVRIDSKRATAVSLMKVGKRSRLKMSCVKPCAEDSLTKSELNFDVLKEAKMFYFNTHSLLDRNMRSTTLQAIKISKHFGGVIFYDLNLPIPLWHSSEETMMFIQQAWNLADIIEVTKQELEFLCGITPSEEFDXTKNNARSKFVHYEPEVVAPLWHENLKVLFVTNGTSKIHYYTKELDGAVLGMEDAPITPFTCDMSATGDGIVAALMRMLTVQPDLLTDKGYLEHSIKYAIDCGVIDQWILGRVRGFPPHEDMEEDITPDSNGIRSISETEYRTAVGSASE

SEQ ID NO: 7837 - protein, 381 aa, Glycine max
  unsure (1)..(381): unsure at all Xaa locations
NWLIRMFYFFFESRSNKDDPVVIWLTGGPGCGGELALFYENGPFHIANNLSLVWNDFGWDQASNILFVDQPTGTGFSYSSDASDIRNDEVGISNDLYDFLQEFFKAHPEFVKNDFYITGESYAGHYVPALASRVIQGNKENQGIYINLKGLAIGNGATNPAIQYQAYPDFALDNKIITKANYDEINKLIPDCEQAAKTCETQGGQSCAIAFNTCQKIFYHILDFAPGINYYDIRKXCKGDWCYDFRNVETLLNLPKVKSVIGVSNDLQYVSCSKRVHEAMMQDYMRNMEVEIPSLLEDGIKLLVYVGEEDLICNWLGEPTNSKIFXVKFVVDGSKAICKGLLKXYAPLSFLKVHEAGHLVPMDQPKAALQMLQSWMAGKLT

SEQ ID NO: 7838 - protein, 638 aa, GIBBERELLA ZEAE PH-1
MVLSAHEISQLRAALQDAVVKCSERCLYQSSKWAAELLNALPETDDDEENINPADPSHVSPIFAANNDPEEAILEARELSKYLLAKSLFDCREYDRCAAVFLPDSLLSSVLASRVDHASASSAAGKGKSKASEAAVPLPKLSQKSLFLALYAKFMSGEKRRNEDSEMVMGPQDLGTVTNKQLLVIGHFLATWFEERTTEDDEVLGSQGWLEYLYGMVLAKEKNDDKALEYFIRSVHKYTMNWGCWLEMTSLISRVEDGPGLANSLEQLLSIFPTSSFLLTCNALLAYHAKDLMAAEQHFTRLLALHPHRLDSLDHYSNILYVLNLRPKLAFLAHLCSSVDKFRPESCVVIGNYYSLLSMHEKAVQYFRRALTLDRSCLSAWTLMGHEYVELKNTHAAIESYRRAVDVNRRDYRAWYGLGQTYEMLEMHTYSLWYYKKAAGLRPWDGKMWMAVGSCLQKMGRERDGIKALKRALLADAYYDVGSSFGSGDLLGSRNATGHMDPDILLQIAVMYDQLGEEEEARSYMELCVAQEDGSGGAAGAEVDPGESIAIHNDSPAGSENGAENDENSNNEGTGVTAATSKARMWLAKFSMRTGDYMTASRLAGELCQDGVEVEEAKALVREVRSRMEATGMLDPLS

SEQ ID NO: 7839 - protein, 381 aa, Oryza sativa
  unsure (1)..(381): unsure at all Xaa locations
MASSAAAATATDRAALVKAFDETRTGVRGLVESGVSAVPDIFRHPDPYASVPLAPPGVSIPVVDLSLPAPLAAEAAAGAAREWGFFYLVNHHALVPPGFTDGLLAATRAFHELPAAERAAHYGRSVDGGVDYFSNFDLYRSGAASWRDTIKVTFGPSRPDTGRIPAACRAEVVGWDAHATAVARAVMALLCEGLGLAADALEEASCLEGRVMVCHYYPVCPEPERTMGVVPHTDPVVLTILAQDDVGGLQVKHTNEDGERYWVDAKPVPGALMINVGDLLQIMSNDKYKSVEHRVVMNSHEEARVSSAIFYNPGKRXTTVFYGPLPELVSSENPPKYRNFTMPEFLGTFFKRELASNAPYPSTSKYEIIQMLQEKGLNFCM

SEQ ID NO: 7840 - protein, 460 aa, GIBBERELLA ZEAE PH-1
MKLLQLAALVASISPFASAADANAWKSRNIYFALTDRVARSDSDSGGNACSNLGNYCGGTFKGLEAKLDYIKGMGFDAIWITPVVENTDGGYHGYWAKDLYEVNAKYGTKDDLKSLVKTAHSKNIYVMADVVANHMGKGIQDHRPEPLNQQSSYHSPCAIDYNNQNSIEQCEIADLPDLNTGSETVKKVLNDWISWLVTEYSFDGIRIDTVKHVEKSFWPDFQKAAGVYAIGEVWDGSPDYLAGYSKVMPGLLNYAIYYPMNRFYQQKGDPSAVVDMYNEISQKFDDPTVLGTFIDNHDNPRWLSQKNDKALLKNALAYVILSRGIPIVYYGTEQGYAGGNDPANREDLWRSSFKTDSDLYQTISKLGKARSAVGGLAGNDQKFLKSNDSALIWSRANNDLIVVTMNRGQGFSGQYCFNTGANNKTWERVLGQGTVKSDGSGQLCVSYTNGEPEVLVAAN

SEQ ID NO: 7841 - protein, 214 aa, Clostridium tetani
MKFFIDTANVEEIKKVAKWGVLDGVTTNPTLIAREGRDLKEVIEEICSIVDGPISAEVISLESEKMVEEAKELIKIHKNIVIKVPMCEEGLKAVSELTKLGIKTNVTLIFSAQQALLAAKAGATYVSPFLGRIDDIGSFGIQLVEDIVTIFTNFGIESEIICASIRTPIHVLECARVGGDIATVPYKVFAQMLKHPLTDRGIEQFLEDYKSMNK

SEQ ID NO: 7842 - protein, 477 aa, Nitophyllum punctatum
  unsure (1)..(477): unsure at all Xaa locations
KNERYESGVIPYAKMGYWDPNYVIKETDVLALFRVSPQPGVDPVEASAAVAGESSTATWTVVWTDLLTACDLYRAKAYKVEAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEEMYERAEFAKQLGTVIVMIDLVIGYTAIQTMGIWARKNDMILHLHRAGNSTYSRQKIHGMNFRVICKWMRMAGVDHIHAGTVVGKLEGDPLMIQGFYDTLLKSHLDINLPLGIFFQQDWASLRKVTPVASGGIHCGQMHQVLDYLGNDDVLQFGGGTIGXADGIQAGATANRVALESMLMAKNEGRDYVAEGPQILRDTAXTCGPLQTALDLWKDITFNYTSTDTADFVETPTANV

SEQ ID NO: 7843 - protein, 353 aa, Trichoderma atroviride
MGCGMSTEDKEGKARNEEIENQLKRDKMMQRNEIKMLLLGAGESGKSTILKQMKLIHEGGYSRDERESFKEIIFSNTVQSMRVILEAMESLELPLQDQRMEYHVQTIFIQPAQIEGDVLPPEVGGAIEALWKDHGVQECFKRSREYQLNDSARYYFDNIVRIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 7844 - protein, 285 aa, Glycine max
  unsure (1)..(285): unsure at all Xaa locations
HTTPHYTTLHCTYPVSESSCESRTPGIFGYLKLLHSIFSSPCPRVITPPPTTTSTTRLGNEVVPHLPLPLWSEDTVSREPYTGKAVIGMDVGSSEFYXEYNTYDLNFKEDNNDGSHRICGDALKDLYKSFVSEYPIVSIEDPFDQDDWEHYAKITGEVGANVQIVGDDLLATNPNRVQKAIDTKACNALLLKANQIGSATEXVKLARSSKSCWKKAGWGVMASHRSEETEDTFIADLSVGLATGXQTKTGAPCKTDXVAKYNQLLRIEEELDAEVRPVDPRVRTK

SEQ ID NO: 7845 - protein, 150 aa, Glycine max
MDWDGKEFAWDPRGLELLANGEGQKSEAASVDLRLGGEKTAPDVVAKDTKDSKTVSSPSGSSKRSRLQNGSQNMCCSVDGCNSDLSDCREYHRRHRVCEKHSKTPVVMVGGKQQRFCQQCSKFHSLGEFDEVKRSCRKRLDGHNRRRRKP

SEQ ID NO: 7846 - protein, 195 aa, Yersinia pestis CO92
MNILRIGLVSVSDRASSGIYQDKGIPALEEWLTSALTTPFEVETRLIPDEQSLIEQTLCELVDEMGCHLVLTTGGTGPARRDVTPDATLAIADRQMPGFGEQMRQISLHYVPTAILSRQVGVIRKQALIINLPGQPKSIKETLEGVKDAQSNVVVAGIFASVPYCIQLLDGPYIETNTDVVVAFRPKSAIIDIKD

SEQ ID NO: 7847 - protein, 207 aa, Candida albicans
MNNEYDYLFKLLLIGDSGVGKSCLLLRFADDTYTPDYISTIGVDFKIRTIELDGKTIKLQIWDTAGQERFRTITSSYYRGAHGIIIVYDVTDQESFNNVKQWLQEIDRYATGGVMKLLVGNKADLSDKKIVEYTAAKEFADALDIPFLETSALSSTNVEQAFYTMARQIKAQMTNNANAGNAANAKGKSNVNLRGESLTSNQSNSCC

SEQ ID NO: 7848 - protein, 422 aa, Bartonella henselae [sequence omitted]

SEQ ID NO: 7849 - protein, 355 aa, Ralstonia metallidurans
MKIAVLPGDGIGPEIVAEAVKVLNALDEKFEMETAPVGGAGYEAEGHPLPDNTLKLAKEADAILFGAVGDWKYDSLDRPLRPEQAILGLRKHLQLFANFRPAICYPELTGASSLKPELVAGLDILIVRELNGDIYFGQPRGVREAPDGLFKGAREGFDTMRYSEPEVRRIAHVAFQAAAKRGKKLCSVDKANVLETFQFWKDIVIDVSKEYPDVELSHMYVDNAAMQLVKAPKSFDVIVTGNMFGDILSDEAAMLTGSIGMLPSASLDANNKGLYEPSHGSAPDIAGKGVANPLATILSAAMMLRYSLNRAEQADRIENAVKKVLAQGYRTADIVTPGCKQVGTREMGEAVLAAL

SEQ ID NO: 7850 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGLAAARFGLSLVRALQGEQGVVECAYVEGDGQYARFFSQPLLLGKNGVEERKSIGTLSAFEQNAL

SEQ ID NO: 7851 - protein, 839 aa, Neurospora crassa
MASRSARMDDGYPSSSATPAAFDSQHEWEEHRRATIEDDRDELDLLGEDNDHNNNHDNDNDMILDEDPLRDDLDQPMSFKRRQKKQSVFSQPSRLFSALTGGRSPRTSHDVPGRPSPTSNTRLDGTQSGSKDGGPMDWYVEGPGRRVGYEDLTAIDWIFEYTKERSRLRMLSSGSNSLVGRIRLLLDNSQVWIVLLLAGLAAGLLAAAIDVATDWLADLKFGFCSTVDGGAFHLSKSSCCLGYEDHAQCQGWYPWAKAFGIYSGGGKWFLEYFFYVFLALSFAVSAAILVKEYAIHAKHSGIPEIKTVLGGFVIRRFLGIQTLVTKSLGLVLAVASGMWLGKEGPLVHVACCCANVFIKLFPSINNNEARKREILSAAAAAGISVAFGSPIGGVLFSLEQLSYYFPDKTMWQSFVCAMTAAVTLQALDPFRSGKLVLYQVKYSSGWHGFELVPFVLLGILGGVYGGLFIKANMRVAEWKKSTRWLPGPVTQVAIVAALTALINYPNHYMRAQTSELVSNLFTECAKIVDDQFGLCKTGAASFGTITLLIFAAVLGFFFAAVTFGLQIPAGIILPSMAIGALTGRALGILMELFQRAAPNFPLFLHQCEPDVPCITPGTYAIIGAAAFLTGVTRMTVSIVVITFELTGALTYVLPIMISVMIAKWVGDAFSRRGIYESWIHFNSYPYLDPNNSGEDLSPLIPDVPASQIMTRLDSDLIVLTATGHTIASLQKILETTPYRGYPVISNPRDAVLLGYISRAELSYVLYSPGGRASNLPPETECFFSHQPLADPLTTLDLRPWMDQTPLTLPGRSPLHLARTSLDNLGIKITAWPGTATVNR

SEQ ID NO: 7852 - protein, 291 aa, Caulobacter crescentus CB15
MKPVRKAVLPVAGLGTRVLPGTKTTPKELLNVVDRPILSYIVEEGRKAGIEHFVFVTGRSKGAIEDYFDHQIELEAQLEAKGKIEILEQLRAELPKPGEMSFVRQMAPLGLGHAVWCARDIIGDEPFAVMLPDVIVDAERACLGQLIDLYNKVGGGNVIGVEEVPESETHKYGVVAPGKVDGRMATMTGMVEKPAKGTAPSNWAIAGRYILQPEIFALLAAQEKGAGNEIQLTDSMAKLMQDQAFHAYVYEGVTHDCGDKIGLLRANVALALKRADLGAAARAAVEAALKA

SEQ ID NO: 7853 - protein, 124 aa, Triticum aestivum
  unsure (1)..(124): unsure at all Xaa locations
MYSNVGTSLTRXSSKSETLQSLQSIYEQESGCLSRRRVRFQIAEEEQINPQVRDELSDLLEAKEAGVAYIIGHSYVKARKNSNFLKSFAIDYAYSFLRKNCRGPSVTLHIPHISLIEVGMIYYV

SEQ ID NO: 7854 - protein, 428 aa, Pfiesteria piscicida
MKWGDVGGSGSKDVPIAKDAARGAEIGGRGAAVAPSIGQSESSGSFQKLCGEVLLDLPKHLVAVKQVGKGAYGEVFLCKDERTQGQVAVKVIRDFTKDLLFGKRIFREVKILMALQHENLMRLIDLPAVPSPDFNVVYMVMPYMLADLHRMIYSSLKLVESHCQAFTCQILRGLKYLHSAGIVHRDLKPANIMVNKNCTLRITDFGLARGRCDDEEVLTDYVVTRWYRAPELMLVPSSYFEAIDLWSVGCIHFECVARTVLFPGEHHFDMLKKIADTLGMFTPEGVAWCPQDQKGEVDTMLNKLEDLRSKELNSLASRLPEASEVCLDLLLKLLDKVPSTRISAAEALEHPYLQHLRDPAGETVAKRPFAWDFDVFEPSERALKDRIYAECARIHPEIITRDAKYLMDRGFKVPAQRPSPADEKPDGS

SEQ ID NO: 7855 - protein, 371 aa, Zea mays
  unsure (1)..(371): unsure at all Xaa locations
MRRHMAPIKEQKHTTSAEQQVMLDAELQLWNHTFGYVKSMALKAAIDLGIPEAIHQHGGTATLPQIVTRVKLHPSKTPCLRRLMRVLTLTGVFGAQEAHDDDGGCDDELVYTLTPASRLLVGSPGQNVGPFLTLMLGPIFVSSFLDLRGWFQHETPDPSPFKMTHGRDIWELAAHDAAFGRLFDAGMVADSSFIMDVVVREXGGVFEGISSLVDVAGGLGGATQTIAKAFPNLECSVLDLPNVVASAPTDTAVKYVPGDMFESVPAADAVFLKWIMHDWGDADCVKILKNCKKAIPAQGGKVIILDIVVGAGSSCDRKNVETQCLFDLFIMFINGAERDERQWKKIIFEAGFTSYKIIPVLGIRSIIEVCL

SEQ ID NO: 7856 - protein, 504 aa, Arabidopsis thaliana
MKTMWWRDMRSLLIVPMFKCLVAICLVISLLVFVESLYMNIVVIYVKLCKRKPEKIYKWEAMQEDLELGNQNFPMVLVQIPMYNEREVFKLSIGAACRLIWPLDRLIVQVLDDSTDPTIMEMVSTECGKWATKGINIKCERRDNRNGYKAGALKQGMRHSYVKTCTYIAIFDADFQPEPDYLERTVPFLIHNPELALVQARWKFVNAKKCLMTRMQEMSLNYHFTAEQESGSTRHAFFGFNGTAGVWRLAAMEEAGGWKDRTTVEDMDLAVRVGLHGWKFVFVNDVSVKSELPSQFKAFRFQQHRWSCGPANLFRKMTMEIIRNKRVTIWKKLYVIYSFFFVRKIIVHFFTFFFYCFILPTSVFFPEVNIPTWSTVYFPFMITLFNAIATPRSFYLVIFWVLFENVMAMHRTKGTFIGLLEGGRVNEWVVTEKLGDALETKLLPQVRKPRNGFLERINSKEMMVGIYILCCASYNLVFGKTVLYIYLYMQALAFIIAGIGFIGT

SEQ ID NO: 7857 - protein, 336 aa, Trichodesmium erythraeum IMS101
MSAIVDFSASINPLGLPDSAIQAIQTNISKLGAYPDPNYQELKKALSLAHPPLTSEWILPGNGAAELLTWAALDLSKLEAVYLLTPAFGDYRRALKTFTANVIECPLKVGESKLTELQELQIEIDTDKGLLLNNPHNPTGLLMEVETIVPFLEKFGLVVVDEAFMDFLPPPQAQSLVPLVTKFHNLVILRSLTKFYSLPGLRLGYAISHPERLRKWQKWRDPWPVNTLAIAAAQAVLEDQVFQQQTWDWLADARPQLFQGLAELPGLQPCPGAANFLLVHSEKSVDWLQTTLLKKHRILIRDGSSFPELGDRYFRVAVRTQEDNQKLVDALGQILK

SEQ ID NO: 7858 - protein, 378 aa, Wolbachia endosymbiont of Tunga penetrans
MSDLAKRMSLIKPSPTIAVTDKANRLKSEGKKICVLAAGEPDFDTPGHVKKAAIQAINEGKTKYTAVDGTLELKEAIINKLKKDNSLKYTPSQICVGAGAKQVLFNLFMATVNPGDEAIIPAPYWVSYVDMVSLFGGLPVVVECKQSFKLTPELLKSKITKKTKWLILNSPNNPAGVIYTYDELKGIAQILLEYPHVNVVTDDIYEHIIYDEKFFTIAQVEPKLYDRIFVVNGVSKAYAMTGWRIGYIAGRSDVIKAISTLQSQSTSNPNSIAQAAAVEALNGDHDFLKERTKIFKSRRDFVVEKLNSVPGLSASTPQGAFYLFVSCEGLLGKSTRSGKVINNDLDFAEYLLEDHLVAVVPGIAFGLKNFVRISYATS

SEQ ID NO: 7859 - protein, 290 aa, Ralstonia metallidurans
MTIRIGINGFGRIGRMVFRAAVQDFKNDIEVVAINDLLEPDYLAYMLRYDSVHGRFKGEVVVDGGTLVVNGRKIRLTAVKDPAALAWGDVGVDVVVESTGLFLTHDTCQKHLDAGARKVIQSAPSKDDTPMFVYGVNHTQYAGEKIVSNASCTTNCLAPVAKVLNDSFGIKRGMMTTVHAATATQKTVDGPSNKDWRGGRGILENIIPSSTGAAKAMGRVIPALNNKLTGMALRVPTSDVSVVDLTVELAQETSYEKICAAMKAASQGAMKGVLGYTQDKVVSTDFRGEA

SEQ ID NO: 7860 - protein, 385 aa, Oenococcus oeni MCW
MALNNTELDEILAIHSKNVGVLDVKADMDVESRQDLGKAYTPGVAALSKIIERNPGLKDKYTISGKLVAVVTDGSAVLGLGNIGTAAGLPIVEGKSLLYKDLANVNAIPVAIDQVPVDEFVQTVKNFSNTFAGIHLEDIAAPRCFEIEEKLKQTLDIPVYHDDQEGTAIVVLAGLINAAKVVGKNLKDLRIVINGIGAAGVATARLLFSIGIKKLTLVDIHGVVKADDSDYNKYQRKLAKDINLNISGQTLDNVIDQQDVFIGLSDGDVLSADQVKRMSSKPIVFALANPLPEINPEIAQTAGAQVIATGSAQYLNQVNNVLVFPGLYKGLLTYGIKQVDYKIEEVVAKALASMVENPTSDKIVPGVFEAGVVVTVANALKTFAG

SEQ ID NO: 7861 - protein, 336 aa, Geobacter metallireducens
MQIGMIGLGRMGADMVRRLRKGGHECVVYDLNVNAVQALEREGIAGARSIEEFCAKLVKPRVVWLMVPAAVVDSMLQRMTPLLAANDIVIDGGNSHYQDDIRRADQMRAQGITYVDVGTSGGIFGLERGYCLMIGGEKQAVERLDPVFRTLAPGIGAAPRTPGREKREGTAELGYLHCGPSGAGHFVKMVHNGIEYGLMAAYAEGLNILHHANAGKEGQGADAETAPLRNPDFYRYDLDLADITEVWRRGSVISSWLLDLSATALLDSPDLQEFQGRVSDSGEGRWTVAAAIDEGVPAHVLSSALYERFSSRGEDDFANRLLSAMRYEFGGHREKS

SEQ ID NO: 7862 - protein, 424 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTA

SEQ ID NO: 7863 - protein, 402 aa, Glycine max
MLLPTFDADACDGEDPSNFPMVLVQIPMCNEREVYSQSIGAAAQLDWPKDRILIQVLDDSDDGNLQLLIKEEVASWKEKGVNIVYRHRLIRTGYKAGNLKSAMSCDYVKDYEFVAIFDADFQPNPDFLKLTIPHFKGKPDLGLVQARWSFVNKDENLLTRLQNINLCFHFEVEQQVNGYFLNFFGFNGTAGVWRIKALEESGGWLERTTVEDMDIAVRAHLNGWKFIFLNDVKVLCELPESYEAYKKQQHRWHSGPMQLFRLCLPAILTSKISVWKKANLIFLFFLLRKLILPFYSFTLFCIILPLTMFIPESELPLWVICYVPIIMSFLNILPSPKSFPFLVPYLLFENTMSVTKFNAMISGLFQLGSAYEWVVTKKTGRSSESDLLALAERESKSSNEEQ

SEQ ID NO: 7864 - protein, 479 aa, Scytosiphon lomentaria
  unsure (1)..(479): unsure at all Xaa locations
RIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLXGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYFLGDDVVLQFGGGTIGHPDGIQSGATANRVALESMVLARNEGRDYVGEGPEILRRAASTCGPLKAALDLWKDITFDYTSTDTPDFVEVATGSR

SEQ ID NO: 7865 - protein, 148 aa, Yersinia kristensenii
KGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLV

SEQ ID NO: 7866 - protein, 542 aa, Oryza sativa (japonica cultivar-group); identical to SEQ ID NO: 3643

SEQ ID NO: 7867 - protein, 390 aa, Synechocystis sp. PCC 6803
MISVAAAVEIIQAHWPNFGDTTMDVDGSYGRVLAESIEADRDYPPGDRVMMDGVALAWSEYHQGRRHFKLLGTVAAGTPQSSLPDQTGCLEVMTGALLPQNCDLVIPYEEVAIADNQVKIINPRQREPGEFVHPKASDCRAGKVILESSSKLNGPAWNIITSFGKTKVRVKQKPRIQIISTGDELVEITQKPKIHQLRRSNIYGLQVSLQSRGFQNVNLTHLADDKEVIIRHYQKAKLEYRVLIYSGGISKGKFDYLPEVWSQLGVTKYIHGVAQKPGKPMYFGIDHRSKTVIIGLPGNPISSLVCLHRYFLDSAPIYAQLTTDFTFKKDLTYFLPVKLSHTPQAVIKAEPLPVKNSGEFIALAGSDGFLELPQHQASFQAGECFPFYAW

SEQ ID NO: 7868 - protein, 327 aa, Saccharomyces cerevisiae
MLHVGEESFQMSTLLERTKSVQELKKRAAGKTSANPAEVAKAKKVLRRLYSWDEIPEWQRDNDFILHGYVKETSSFIETFKSLFYLHNESVNIYSHLIPALGFFTVLLLDKSTIKVFATTTWLDHMVIDLFYSGAFACLILSSSFHCLKSHSLRIATLGNKLDYLGICILIVTSMVSILYYGYFEKFSLFCLFALITVSFGIACSIVSLKDKFRKREWRPYRAGLFVCFGLSSIIPIFSGLYCYSFSEIWTQIQLFWVLLGGVLYIIGAVLYGMRFPEKICPGKFDIWGHSHQLFHFLVVIAALCHLRGLLNSYELVHIKMENGIVS

SEQ ID NO: 7869 - protein, 623 aa, Streptomyces violaceus
MDLSRLLDPSCPPFALLRRRTPGRDHDTVEVLIGRVHEAERLAELPVGPLPALALVPFRQIRERGFDVRDDGTPLSVLVAEETHTLPLAEALDRLPAHDVTVEDGGFDVSDEEYAGIVRRVIDEEIGSGEGANFVIRRTYTGEIPGFGRADALALFRRLLAGERGAYWTFVVHTGDRTLVGASPEVHVRMSGGTVVMNPISGTYRYPAGAAPTAEGLLAFLADRKETEELSMVVDEELKMMCTVGDMGGVVIGPRLKEMAHLAHTEYELRGRSSLDVREVLRETMFAATVTGSPVQNACRVIERHEVGGRGYYAGALALLGTDENGAQSLDSPILIRTADIAADGHLRVPVGATLVRHSDPAGEVAETHAKAAGVLTALGVREGRPAGGPAPAPTALADDPRVRAALDARRADLAPFWLRMQVRSAELSGHALVIDAEDTFTAMLAHVLRSSGLDVSVLRYDEPGLRELALAHEGPVVLGPGPGNPSDAADPKMRFLRALTADLVRDHRHGLLGVCLGHELIAAELGLEIVRKRTPFQGAQMRIDLFGQERTVGFYNSFTARCDERTATELALHRIEVSRDAETGEVHALRGPGFAGVQFHPESVLTTDGAALTASLLAGVLV

SEQ ID NO: 7870 - protein, 477 aa, Yersinia pestis KIM
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 7871 - protein, 411 aa, Magnetospirillum magnetotacticum
MTGRFAAGSDLMSVAQALSLLEARLSPAVGTEETGLHHALGRILAEDLVSGVNVPPHDNSAVDGWAFRRADLPADGILPVVGRVAAGHPLEGPLPQGGAVRIFTGAPMPTGADTVAMQEDCKDLGGSVALPAKLAEGDNARAAGEDISKGSVVLHAGTRLRPQELGVAAATGRSSLKVFRPLRAAVFSTGDEIRNPGTELPPGCIFDTNRFTATGLLRALGAEVTDLGILPDRFEVIRDALAEAAASHQLILTSGGVSVGDEDHVKPAVLAQGSLDFWRLAIKPGRPVALGEVKGTPFVGLPGNPVAVMVTFMAIARPMVLRLMGAAQTDLPRYPVEAGFAFRHKPGRREYLRARLAHMDGRLVAAKFPSDGSGVLTSMTWSDGLVDIPEDRGDIAPGEMVEFLSYADMMR

SEQ ID NO: 7872 - protein, 489 aa, Vaucheria schleicheri
MSSKSVQERTRIKSQRYESGVIPYAKMGYWDAFYNVKETDVLALFRITPQPGVDPVEAAAAVAGESSTATWTVVWTDLLTACDIYRAKAYRVDPVPGTTDQYFAYIAYQIELFEEGSLANLTASIIGNVFGFKAVKALRLEDMRIPFAYLKTFQGPATGLIVERERMDKFGRPFLGATVKPKLGLSGKNYGRVVYEGLRGGLDFLKDDENINSQPFMRWRERFLYCMEGVNRAVAATGEVKGSYLNATAGTMEEMYERANYAKSLGTIIVMIDLVIGYTAIQTMAIWARKADMILHLHRAGNSTYARQKNHGINFRVICKWMRMAGVDHIHAGTVVGKLEGDPLMVKGFYNALLKTKLEIDLPQGLFFEMEWAALRKVVPVASGGIHCGQMHQLLYYLGDDVVLQFGGGTIGHPDGIQAGATANRVALEAMVLARNEGRDYLNEGPQILRDAAKTCGPLKTALDLWKDITFEYTSTDTPDFVEIPTQSN

SEQ ID NO: 7873 - protein, 469 aa, Streptomyces coelicolor A3(2)
MFQNADDVKKFIADEDVKFVDVRFCDLPGVMQHFTLPATAFDPDAEQAFDGSSIRGFQAIHESDMSLRPDLSTARVDPFRRDKTLNINFFIHDPITGEQYSRDPRNVAKKAEAYLASTGIADTAFFGPEAEFYVFDSVRFATRENESFYHIDSEAGAWNTGALEDNRGYKVRYKGGYFPVPPVDHFADLRAEISLELERSGLQVERQHHEVGTAGQAEINYKFNTLLAAADDLQLFKYIVKNVAWKNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRVEFRAPDASGNPYLAFSALLLAGLDGIKNKIEPAEPIDKDLYELAPEEHANVAQVPTSLGAVLDRLEADHEFLLQGDVFTPDLIETWIDFKRANEIAPLQLRPHPHEFEMYFDV

SEQ ID NO: 7874 - protein, 740 aa, Zea mays
MASEILGNVTEKAKDLAGSKSTKMAQLAEVTKDVHDDKWRITSDYGVKQNNTDDWLRVATDDQTGPLLLEDQFAREKIHRFDHERIPERVVHARGSGAFGKFTLFESASDVTSAGILTDTSRETPVFLRFSTVLGSRGSADTVRDVRGFAVKFYTEEGNWDIVGNNIPVFFIQDSMKFPDVIHAGKPEPDCEVPQAQSAHNNFWDFQYMHPEATHMFMWAMSDRTIPRSYRMMQGFGVNTYTLINAKGERHFVKFHFTPELGVHSFVWDEALKIAGQDPDFHRKDLWMAIDSGAYPKWKFGIQVIPEAKEHDFEFDILDATKVWPEELVPVRYIGELELNKNPDEFFTQTEQVAFCTSHIVPGIGFSNDPLLQGRNFSYQDTQLSRLGINWEELPINKPVCPVMNFNRDGAMRHTITKGKVNYWPNRFQTVPPATEKEGAYVEFPEKTAGMKVRMQSKKFREHKSQAELFYNSMSENEKMHMKAAFAFELDHCDDPVVYERLCERLCEIDLELAQSVAEMVGGEQPTKQTRPKHNKKAKGLSQMDFQPEKPTIATRMVAILIADGYDKAAYTGMKAALTAAGALPFTISPRRNKIFADGEDKSGSGVVADHHLEGQRSTMYDSVFVPGGAKSIETLSKNGRAVHWVREAFGHLKAIGGTGEAVSFIKQAVDLPGMEFSTSGDVVNSYGVVTATAVQPESFKEAVNMAKEAKDFVSAYMYAISQHKNFERETAGLNAMVAY

SEQ ID NO: 7875 - protein, 154 aa, Xanthomonas campestris pv. campestris str. ATCC 33913
MSQFDLTPPSPAQRDALIAGLSDEEQRVLLHHGTEAPFCGVFLDNKLDGVYTCRLCGLPLFRSNAKFDSGTGWPSFFAPYDPAHVREIRDTGYGMIRTEIVCARCDSHLGHVFPDGPPPTGERHCLNSVSLAFTEDGQPLPNPLQRAGADTQPA

SEQ ID NO: 7876 - protein, 373 aa, Triticum aestivum
MPSTESAAGVAWDRRRELQAFDDTKAGVKGLVDAGVTALPPIFRHSPESLEGITSSNHVAGAIPTVDLAAPRREDAVALVRHAAGTVGFFQVVNHGVPAELMAGMLEGVRRFNEGPAEAKQAIYSRDQARKVRFASNFDLFSSAAANWRDTLFFHLAPDPAPSEELPEAVRDVVTEYGHAVTKVGLSVLELLSESLGLSSDHLRDMDCAENLNAVCQYYPPCPEPYLTWGTKRHTDPGFLTVLLQDGMGGLQVLVDGKTWVDVPPVPGAFIINIGDLLQLVSNDQFRSVEHRVLANKSKDTARVSVASFFNTNIERSTRLYGPITDGRNPPIYRSVTAREFIATFNRIGLDGRSLDQYRLDRDTPTPAVEGCE

SEQ ID NO: 7877 - protein, 232 aa, Syringa vulgaris
  unsure (1)..(232): unsure at all Xaa locations
RMENKINRQVTFAKRRNGLLKKAYELSVLCDAEVALIIFSNRGKLYEFCSSSSMLRTLERYEKCNYGAPEPHVSSREALELSSQQEYLKLKARYEALQRSQRNLLGEDLGPLNSKELESLERQLDMSLKQIRSTRTQAMLDTLTDLQRKEHALNEANQSLKQRLMEGNHISLQWNQDPEEVGYGREPTQHQPHGFFHPLECEPTLQIGYQNDPMAAAGPSLNNFMSGWLPXI

SEQ ID NO: 7878 - protein, 293 aa, Escherichia coli K12
MKMRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGGDDCALVLGDNIFYGHDLPKLMEAAVNKESGATVFAYHVNDPERYGVVEFDKNGTAISLEEKPLEPKSNYAVTGLYFYDNDVVQMAKNLKPSARGELEITDINRIYLEQGRLSVAMMGRGYAWLDTGTHQSLIEASNFIATIEERQGLKVSCPEEIAFRKGFIDVEQVRKLAVPLIKNNYGQYLYKMTKDSN

SEQ ID NO: 7879 - protein, 294 aa, Escherichia vulneris
IVFRAAQERSDIEIVGINDLLDADYMAYMLKYDSTHGRFNGTVEVKDGHLVVNGKTIRVTAEKDPANLKWDEIGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGDMKGVLGYTEDDVVSTDFNGEICTSVFDAKAGIALNDNFVKLV

SEQ ID NO: 7880 - protein, 391 aa, Geobacter metallireducens
MKFAISDQIRSVHAPPITEVKGWLASREPDPGRHLIDLCQAVPDYAPARQLTDYLATCLDDPAMAKYSPDEGLLEVREGVCARYGRVYGAAPAPEGVCLTIGASQAFWLAMVTLCRAGDEVIVPLPAYFDHPMALEMLGLRPVWLPFDEKRGGVVDPAAVERLITPRTRAILLVTPSNPTGVVTPPDVIHELYSLARRRGTALVIDETYADFIPGGAAPHDLFADPHWGDHLVQIMSFGKTYALTGYRAGCLVASDAFISHALKAQDTMAVCQPRITQHAVLYGVRHLDDWVAENRLMMERRHDLFRSVFTRPGNPFELAASGTFFAWVRHPFPGKTGREAARRLAVEAGVICLPGEVFGPGLEPYLRLAFGNIREEAIPEAVERFRGLAV

SEQ ID NO: 7881 - protein, 186 aa, Zea mays
MAPSAALAPVAFRSAFSTPLASNPTRNRINIEGAFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 7882 - protein, 78 aa, Desulfitobacterium hafniense
MTSITQIHAREILDSRGNPTLEAEVTLADGSFGRAMVPSGASTGSKEAVELRDGDKTRYLGKGVRKAVENVNTTMGIL

SEQ ID NO: 7883 - protein, 241 aa, Zea mays
  unsure (1)..(241): unsure at all Xaa locations
QFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARXKGIQEGYYIRSGIVVILKNATINDGSVI

SEQ ID NO: 7884 - protein, 474 aa, Womersleya monanthos
RYESGVIPYAKMGYWDPEYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVESERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIVMIDLVIGYSAIQSMAIWARQNDMILHLHRAGNSTYSRQKIHGMNFRVICKWMRMAGVDHIHAGTVVGKLEGDPLMIRGFYNTLLLPYLDINLPQGIFFTQDWASLRKVTPVASGGIHCGQMHQLLDYLGNDVVLQFGGGTIGHPDGIQAGATANRVALESMVIARNEGRAYVQEGPQILRDAAKTCGPLQTALDLWKDITFNYTSTDTADFVETPTANV

SEQ ID NO: 7885 - protein, 310 aa, Chara vulgaris
FGRIGRLVLRAALLNHPEIEVVAVNDPFIDTKYMVYMFKYDSVHGQFKGKISAKDEKTLIINGKEVAVYGSRDPAAIPWSDTGVEVVVESTGVFTDKDKAAAHIKGGAKKVIISAPSKDAPMFVVGVNEDKYTPDLTIVSNASCTTNCLAPLAKVINDNFGIVEGLMTTVHSLTATQKTVDGPSGKDWRGGRGAGFNIIPSSTGAAKAVGKVLPELNGKLTGMAFRVPTADVSVVDLTVRLAKPASYDTIKQCIKAASEGPLKGILGYTDEDIVSTDVIGDAHSSVFDAKAGIALNDNFVKLVSWYDNEW

SEQ ID NO: 7886 - protein, 496 aa, Oryza sativa
LRPLILTTNLAFLGSSRLPHSSIDPSIGCWSETMVAAAVAAAEQVVAALREECATPAARLDGVAAAMAGEMAAGLAEEGGSKIKMIVSYVDNLPNGTEEGLFYALDLGGTNFRVLRVQLAGKEKRVVKRESREVSIPPHLMSGNSSELFGFIASALAKFVADEGHNAVFNDRQRELGFTFSFPVRQTSIASGTLIKWTKAFSIDDAVGEDVVAELQMAMEKQGLDMRVSALINDTVGTLAAGSYYDEDIVVGVILGTGSNAAYLEKANAIPKLEGELPKSGNMVINTEWGNFSSSCLPITEYDEALDKESLNPGEQIFEKLISGMYLGEIVRRVLLKISLQSSIFGNLDQTKLKTRFILRTPDISVMHHDGTPDLRIVAEKLADNLKITDTSLETRKMVVEICDIVTRRSARLAAAGIVGILRKIGRGVPGDKRKSVIAIDGGLYEHYTEFRQCLETTLTELLGEEASKSVAVKLANDGSGLGAALIAAAHSQYLN

SEQ ID NO: 7887 - protein, 424 aa, Ballia callitricha
IEASAAVAGESSTATWTVVWTDLLTACDLYRAKAYKVDKVPNSSDQYFAYISYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLYSMEGVNRAQAAAGEIKGHYLNVTSATMEDMYERAAFAKELGSIICMVDLVIGYTAIQTMAIWARKNDMILHLHRAGNSTYSRQKSHGMNFRVICKWMRMAGVDHIHAGTVVGKLEGDPLMIKGFYNTLLDSHLDINLPQGIFFKQEWASLRKVTPVASGGIHCGQMHQLLHYLGDDVVLQFGGGTIGHPDGIQAGATANRVALESIVLARNEGRDYLKEGPQILQDAAKTCGPLQTALDLWKDITFNYTSTDTA

SEQ ID NO: 7888 - protein, 215 aa, Solanum tuberosum
MKDKEVKTRMKRGFWKPEEDLILKNCVETHGEGNWATISEKSGLMRSGKSCRLRWKNYLRPNIKRGMMSEDEKDLIIRLHKLLGNRWSLIAGRLPGRTDNEVKNFWNTHLNNKRSCRGKKKHVKSKEANTQSTQGKMQEYPAETVSNQEVATKTVLDSWIEEMQDFNCSLLSPLTMNNMPFLEDEPFIPILDDIVLLEAFTSTGKEAWNEIQPFL

SEQ ID NO: 7889 - protein, 351 aa, Saccharomyces kluyveri
MSASQIPETQKAVIFYENGGELQYKDIPVPKPKSNEILINVKYSGVCHTDLHAWKGDWPLPTKLPLVGGHEGAGVVVAIGENVKGWKIGDYAGIKWLNGSCMACEYCELSNESNCPEADLSGYTHDGSFQQYATADAVQAARIPAGTDLAEVAPVLCAGITVYKALKSANLRAGEWVAISGACGGLGSLAIQYAKAMGYRVLGIDGGDEKAALFNELGGEVFIDFTKTKDVTKAVIDATNGGAHGVINVSVSEAAIEASTVYCRANGTVVLVGLPGGAKCKSDVFNQVVKSTTIVGSYVGNRADTREALDFFARGLVKSPIKVVGLSELPSIYEKMQKGAIVGRYVVDTSK

SEQ ID NO: 7890 - protein, 500 aa, Oryza sativa
MPPPPLTPLSSSSSRFFFLLVLVLVLSCSLPANGRTHRSPAAAASPSPGPGPSPAPATPRVVPPAPAPATGGGGGGGGIFSSNGSLAVTPAAAAAAVAPSPPLGAVAAMEQRQHHHFHKELIIAIGLASVAGMAIVATVLYACILCRHSHRAHDSKNIRSSSDTARVALVPMLNKFNSMKTNKKGLVAMMEYNTLETATGKFSESNLLGAGGFGCVYKANFEGGLVAAVKRFGHRGQDCEKEFENELDLLGSIRHLNIVSLLGFCIHEENRFIVYELMENGSLEAQLHGPSHGSALSWHIRMKIALDTARGLEYLHEHCNPPVIHRDLKSSNILLDSDFNAKISDFGLAVTSGNHSKGSLKLSGTLGYVAPEYLLDGKLTEKSDVYAFGVVLLELLLGRRPVEKTAQSQCQSIVTWAMPQLTDRSKLPNIIDPMIKNTMDLKHLYQVAAVAVLCVQPEPSYRPLITDVLHSLIPLVPMELGGTLRISPESPCATRKQSPC

SEQ ID NO: 7891 - protein, 368 aa, Rhodospirillum rubrum
MTKAIIPQPRPGIMEISPYVGGESKLAGVDRIIKLSSNEGALGASPRVRDALIASAGEAHRYPDGNATALREALGRTHGLDPARIVCGAGSDELIGLLCRAYAGPGDSIVQSAYGFLMYGIYARGVGAEPILAPESDLTADIDAMLAAVRDTTKLVFLANPNNPTGTCLPTSEVVRLREGLRDDIILVVDAAYAEYVERNDYDAGARLVDSHPNTVMLRTFSKIGLGGLRLGWSYGPAHIIDVLNRVRGPFNICGQALVAGEAALADPAFTDLSRAHNSLWREWTRAKLQAMGIRVGESSGNFVLATFDAEGPFTALAADAALRQQGIICRRVAGYGLPNCLRITIGRDDEMQAVVEALGAFMAGEGR

SEQ ID NO: 7892 - protein, 158 aa, Retama raetam
MSLIPSVFGTGRRTNVFDPFSLDIWDPFQDFPLRTIAPSGFDTETAAVANTRIDWKETPEAHVFKADLPGLKKEEVKVEVEEGRVLQISGERTKEKEDKNDTWHRVECSAGRFLRRFRLPENAKVEQVKASLENGVLTVTVPKEEVKKPDVKPVQITG

SEQ ID NO: 7893 - protein, 303 aa, Actinoplanes sp. 50/110
MRGILLAGGTGSRLRPVTWAVSKQLMPVYDKPMIYYPLATLVSCGIREILVITTETEAAQFQRLLGDGSQWGLRLEFAVQQRPGGIAEAFLIGEEFLAGGPVALMLGDNLLHGVDFRPCVQRARETAGGHVFGVAVADPSAYGVVEFDAAGRVLSIEEKPVRPRSPYAVPGFYLYDADVVETARSLRPSARGELEITEVNQAYLRRGALSVTLLGRGAVWLDTGTLADCMRAVDYVRAIDEGQGIKIGCVEEAAWRAGFLDTAHVRALAEPLMSSGYGQYLLALTGDGLSRTPQWPALTAAAG

SEQ ID NO: 7894 - protein, 364 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTRQVTEAVCNAIAGSNILKMAAAE

SEQ ID NO: 7895 - protein, 367 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTNPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 7896 - protein, 488 aa, Scytosiphon tenellus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAATTCGPLKAALDLWKDITFDYTSTDTPDFVEVATGSR

SEQ ID NO: 7897 - protein, 210 aa, Oceanobacillus iheyensis HTE831
MTKQKPVVIGVAGGSGSGKTSVTRSICQRFTETSILVIEQDYYYKDQSHLPFEERLNTNYDHPLAFDNDLLIEHLQQLMHNEPIEKPVYDYKIHTRSKDVIHVEPKEVIIVEGILILEDPRLVDLMDIKVYVDTDADLRIIRRLMRDIKERGRTLDSVIDQYIQNVRPSHLQFIEPTKRYADIIIPEGGQNHVAIDIMASKIEKILSRGL

SEQ ID NO: 7898 - protein, 341 aa, Arabidopsis thaliana
MFRSMLVRSSASAKQAAIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 7899 - protein, 169 aa, Triticum aestivum
  unsure (1)..(169): unsure at all Xaa locations
ANELAMXIIPNGKSIPADKKGEADISVLQLETAVGAAIKHFKNAHGVNVPRKRFLPVKTCSDLMLVKSDLYTLQHGQLVIDPNRFGPAPLIKLGSDFKKVSSFQSRIPSIPKIVELDHLTITGPVNLGRGVTLKGTVIIVATEGSTIDIPPGSILENVVVQGSLRLLEH

SEQ ID NO: 7900 - protein, 129 aa, Glycine max
  unsure (1)..(129): unsure at all Xaa locations
MADHDPELEAIRQRRMQELMGQRGGAASPQNAGQQKAQEDAKQEAEERRQMMLAQILSSEARERISRIALVKPDKARGVEDVLLRAAQTGGISEKVSEERLISLLEQINTHTSXQXKVTIQRRRFDDHD

SEQ ID NO: 7901 - protein, 129 aa, Lithospermum erythrorhizon
IRTTGGVKSITNYSPVLKAISSAKNMGFSDVLYLDAVNKKYIEEVSSCNIFVVKGNVISTPATNGTILEGITRKSILEVAQDIGFRVEERLIEVEELEDVEEIFCMPQPSCSPVRSITYKGNKIELVRI

SEQ ID NO: 7902 - protein, 492 aa, Pseudomonas putida
MKQYKNFINGRFVESDKRFAGINPATGVRFADVHEATREMVDEAVSAGHRAVRGWGSASVSDRADMLYRIADEIDRRADDFLTAEVSDTGKPVSLASKLDIPRGAANFRIFADILKTAPLDTFRTDLPGGSHAINYAVRKPLGVVGIISPWNLPLLLFSWKVAPALACGNAVVAKPSEETPGTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHVDAPDGSHDR

SEQ ID NO: 7903 - protein, 227 aa, Arabidopsis thaliana
TNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 7904 - protein, 319 aa, Triticum aestivum
  unsure (1)..(319): unsure at all Xaa locations
MASGGGDDAGEKRVTDRYLKREVLGEGTYGVXVFKAIDTKTGETVAIKRIRLGKYKEGVNFTALREIKLLKELKDPNIIELIDAFPYKGNLHLVFEFMETDLEAVIRDRNIVLSPADIKSYIQMMLKGLAFCHKKWVLHRDMKPNNLLIGAEGQLKLGDFGLARIFGSPERNFTHQVFARWYRAPELLFGTKQYGSAVDVWAAXGCIFAELLLRRPFLQGSSDIDQLGKIFAAFGTPKSSQWPDMVCLPDYVEYQFVSAPPLRSLFPMASDDALXIFLSRMFTYDPKSKNTAQXQALRTQVLSXNYQAPTKPNLLPKPN

SEQ ID NO: 7905 - protein, 391 aa, Clostridium tetani E88
MSLDVKEEALRIHEEKKGKLEIIGTMSVETPRDLSLAYTPGIAAPCLEISKDKEKAYKYTIKGKTVAVITNGTAVLGLGDIGPEAGLPVVEGKALLLKRFGGVNAVPISIDSKDADDIVNTIKNISPGFGGIHLEDIKAPECFYIEDKLKEKLNIPVYHDDQHGTSIAVLAGLYNSLKILKKDIEDIKVVINGAGASGIAIAKLLIKAGVKEIILCDLQGALVEGDSTLNNAQKEIAKVTNRNFEKGSLEDVIKNKDVFIGVSDGNLLTKEMVNSMNKDSIVFALANPVPEIMPEEAKKGGARIIATGRSDFPNQINNVLVFPGIFKGALKVGAKDICNEMKIAAAKGLANLIKDNELNEEYIVPSVFEDGVADAVANEVISIAKKLNLTR

SEQ ID NO: 7906 - protein, 672 aa, GIBBERELLA ZEAE PH-1
MDKITDRIAALPADGTYFSLEFFPPKTAMGFSNLRDRLHRMERALRPLFVNVTWGAGGSTSQKSLELAELCQREVGLTTCLHLTCTNMSKKLIDEALSDAKALGIRNILALRGDPPRREEYRDAEDSEDDGGQDFNWAVDLVRYIRKTHGDYFCIGVAAYPEGHAEESHPLGQSVEHDLPYLVQKVQAGADFIQTQLFFDIEAYEHFETTLREHPSGAFNGIPIIPGLMPIQSYQMIKRTTKLSHAKIPDHLLERLDAVKGDDERVKMVGVDIVNELIDKIKDIKSKTPGPKGFHFYTLNLEKAVSFILERANLIPDPPENEEAVVAVDELAIPALQINGNMRSSSHSRSRQSRRHSSVASDPHNYVIVGDRPAVYPEWEATGLEAGGRAEAVNTRANTLAISEGEGALGREATWDDFPNGRFGDARSPAYGEIDGYGVSLHMSVTQAVKLWDYPKTRQDINDLFVKHIQGELSAIPWSEEELRAESSTIKPHLLQLNGKGWWTVASQPAVNGLRSSDATFGWGPPNGFVFQKSFVEFFIPANEWEILKAKLVSSELQDYVCFYASNARGDYVSSDIGGHVDGSTEASPSTNAVTWGVFPGKEIITPTIIEEVSFRAWCEEAFGIWGEWAKVYGRGSESEKLLNGIKDDYWLVNLIHHDYVNRDALWEVLSS

SEQ ID NO: 7907 - protein, 175 aa, Triticum aestivum
MAPAVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 7908 - protein, 407 aa, Neurospora crassa
MANSPLVARPTDALQPPKSLPPSSGGTPSGGLPRSARGQQIAALARPTMDLMEQMNEDEKNKYIKGKKLGEGTYANVYLGHSRLDSSTQVAIKKIKVQKEYQDGIAPDAIREMKYLQKLRGHANIIILHSVFSSKDQNLNLVLEYLPLGDLEMLIRDVDHVRYGAADIKAWMGMLTRAIWWCHDNYVLHRDIKPNNLLIAADGEVKLADFGLARSFADPGVRMTANVITRWYRPPELLFGARHYSGAVDIWSVGLVFAELIIRAPYLPGNSEVEQIALICREIGTPTEENWPGVTQLKEYTVPSDVVPVAGKDKYMGRFGAVGSDGVDLLTKTLVLDPRRRITAREMLEHRWWKADPKPTPKHDLPKKTAGAEEKLAADLKRRNGMVEDDDVRGSKVARKLDFGTAR

SEQ ID NO: 7909 - protein, 285 aa, Arabidopsis thaliana
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVPTKTENAPETFHLNDPYLVPVTFQAKPTFNLNTDAAPLSLNLCLASSFNLNEQPNSRHSAFTMMPSFSDGDSNSSIIRVA

SEQ ID NO: 7910 - protein, 506 aa, Ruta graveolens
MDLLLLEKALLGLFAAAVVAIAVSKLRGKRFKLPPGPFGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 7911 - protein, 185 aa, Zea mays
  unsure (1)..(185): unsure at all Xaa locations
MAPRRSAAETADADRARLHQLGYKQELKRGLSAVSNFAFSFSIISVLMGVTATYNTGLRYGGPASMTLGWLVVTVFNGCVALSMAEICSAYPTSGGLYYWSAKLAGKEWAPLASWVTGWFNIVXQWAGTTSVDFSLAQLIQVIVLLGTGGAXNGGGYLASKYVVLAIYGIIXRLHGLINSLPHRW

SEQ ID NO: 7912 - protein, 617 aa, Bacteroides thetaiotaomicron VPI-5482
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQTKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWCKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFMQKLLQWRKGNEVIAKGQLKHFAPNKGVYVYERKYGDKSVVVFLNGNDREQTIDLVPYQEILPASSAFDLLTEKKVELRNELTLPSREIYLLSF

SEQ ID NO: 7913 - protein, 213 aa, Streptomyces halstedii
MEAGRGAPAAVRAVTVCVARGDPAMELTLVVLIIVVGLVFDFTNGFHDAANAIATSISTRALTPRIALGMAAVTNFAGAFLGTEVAKTVGSGIIGAPEDLSGLLLAMCALLGAIGWNVFTWWRGLPTSSSHALIGGLVGAALAASATVHWSGIVDKVLLPMLLSPLVGVALGYTLHAAVLWTFRHAAPRPLTRRFRLAQTVSAAAMGLGHGLQ

SEQ ID NO: 7914 - protein, 201 aa, Triticum aestivum
  unsure (1)..(201): unsure at all Xaa locations
MVLESTMICIDNSEWMRNGDYSPSRFQAQADAVNLICGAKTQCEPGEXTVGVMTXAGKGVRVLVTPTXDLGKILACMHGLEVGAEANLAAAIQVAQLALKHRQNKRQQQRIIVFIGSPVTYDKKVLETIGKKLKKNNVAPLTLLHFMGETXDDXKPDENWQALIAAVNNSDSXHIVHVPPGXHALSDVLRSSPIFPGRDGV

SEQ ID NO: 7915 - protein, 596 aa, Achlya bisexualis
MQVRRFSSVARKFFVGGNWKCNGSLSQAQSLVDTLNTATIPKNVEVVVAPASIHALSVKSSLRKDIGVSGQDTWSRGNGAFTGEVSAEMLKDAGINYTIIGHSERRQKGETNEEVASKAGYALSKGVSVIACIGETKIEREAQKTMQVVTEQLAAYAKNITDWSNVVIAYEPVWAIGTGLTATPEQAQEVHAGIRSWLKQNVSSAVADATRIIYGGSVTAGNAAELSKKADIDGFLVGGASLKPDFLSIINCQNDKAHQGGPVNIAINGFGRIGRLVLRAAQTNPLLNVVAVNDPFIPTEYMEYMLKHDTVHGHFDGTVRHEGDHIIVNDRKIRVFGEKDPKAIKWGESDVEYVVESTGAFTTKEKASAHLLNGPRKVVISAPSADAPMFVVGVNHDKYDPSMNIVSNASCTTNCLAPLAKVVNDKFGIIEGLMTTVHAVTATQLTVDGPSKKDWRGGRAACFNIIPSSTGAAKAVGKVIPELNGKLTGMSFRVPTANVSVVDLTVRLRNKASYEDIKAAIKYASENELRGILGYTDTAVVSSDFISDPRSSIFDADAGIVLTDDFVKLVSWYDNEWGYSNRVLDLITHMVHTERQ

SEQ ID NO: 7916 - protein, 296 aa, Burkholderia fungorum
MSITVSFPAEVRDWIAQNLTRGVAPQAIVRELVDRKNAVELASAMVNAVASSFLYGTPLPGETLEIGAAPVAYEPEPLRVPDGPLIRLGERKTRVISRMQRPAAVLLDDFLSANECEQLIALARPRLSRSTVVDPVTGRNVVAGHRSSDGMFFRLGETPLIARLEARIAELTGLPVENGEGLQLLHYEAGAESTPHVDYLIAGNPANRESIARSGQRVGTLLMYLNDVEGGGETMFPQTGWSVVPRRGQALYFEYGNRFGLADPSSLHTSTPLRAGEKWVATKWIRTRRFVPRDQA

SEQ ID NO: 7917 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 7918 - protein, 251 aa, Eremothecium gossypii
MSLSREDSVYLAKLAEQAERYEEMVENMKAVASSGQELSVEERNLLSVAYKNVIGARRASWRIVSSIEQKEEAKEKSEYQVKLIRTYRSKIESELTKICDDILSVLDTHLIPSATTGESKVFYYKMKGDYHRYLAEFSSGDVREKATTSSLEAYKSASDIATTELPPTHPIRLGLALNFSVFYYEIQNSPDKACHLAKQAFDDAIAELDTLSEESYKDSTLIMQLLRDNLTLWTSDMSEAGQEEQPADAHE

SEQ ID NO: 7919 - protein, 315 aa, Triticum aestivum
MASLSPSPPRRTPTAGGRQSPFFRDLAPAIPSHRTSGSLDPSSTPPPPPPLFTLDDRLYAQDFSPDRSASNLLPVAPSPSPPTRASSGNRPPSWDRSRAVPPGPCSLSDWLVEPARKEVLALPPPSPPPTRAANAEVRSPVIPLPAPSRTAPSATVTGADGEEWVTVFGFTARETNLVLREFGKCGVILRHCSGPRDGNWLHILYQHQYDARRALEKNGIQLFSGVAIGVKITDPVQRQMDEKMSESNYKGFMVSLPSKSSIQNAGASSNLGDLPRPYDPKAGRNVNRDMGCSTGSVAMPAKSVLAKTMDLIFGI

SEQ ID NO: 7920 - protein, 316 aa, Zea mays
  unsure (1)..(316): unsure at all Xaa locations
MDMALASKASPXPPCNATAAVLPIPKRDKAAANDSTYLNPQAHDSVLGIILGGGAGTRLYPLTKKRAKPAVPLGANYRLIDIPVSTCLNSNISTIYVLXTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYGFSKDVMLQLLREQFPEANDFGSEVIPGATSIGKRVQAYLYDGYXEDIGTIAAFYNA

SEQ ID NO: 7921 - protein, 131 aa, Triticum aestivum
  unsure (1)..(131): unsure at all Xaa locations
MAPTVMASSATSVAPFQGLKSTAGLPVSRRSNGASLGSVSNGGRIRCMQVWPIEGIKXFETLSYLPPLSTEXLLKQVDYLIRSKWVPFLRVNKVGXLPVEHNASPGVXNNGRYWTXLELAMSXCTDAPXIR

SEQ ID NO: 7922 - protein, 131 aa, Clostridium difficile
EVKYKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 7923 - protein, 238 aa, Zea mays; identical to SEQ ID NO: 956

SEQ ID NO: 7924 - protein, 89 aa, Rickettsia rickettsii
MTFIITSTAFKHNDRIPDKFTCKGQNVSPHLEWSNAPSDTKSFALIMDNPDAPVEIAPPHGIWDHWVIYNISASITKLSEGQIDSSIKI

SEQ ID NO: 7925 - protein, 362 aa, Neurospora crassa
MGIFDELNLPAGVLYGDDVLKLFQYAREKQFAIPACNVTSSSTAVAALEAARDQKAPIILQTSQGGAAFFAGKGIKDSAEKREASVAGAIAAAHYIRSIAPIYGIPVVLHTDHCAKKLLPWLDGMLEEDEKFFKANGVPLFSSHMIDLSEEPVEENISTCVKYLKRMAPMKQWLEMEIGITGGEEDGVDNSEVDNASLYTQPEDIWQIEEAFRPISPYFSIAAGFGNVHGVYAPGNVKLHPELLGKHQAYVSEKLGGKDKKPVFFVFHGGSGSSKEEYREAISNGVVKVNVDTDLQWSYLVGIRDYILNNIDYLRSQVGNPEGPNKPNKKKYDPRVWIREGEKTMKARVEEALKDFNAAGTV

SEQ ID NO: 7926 - protein, 98 aa, Buchnera aphidicola
LPSASLNDSNFGLYEPAGGSAPDIAGKNIANPIALILSIAMLVRYTMKLPTISDHIEYAVIDTLKKGYRTADIANDKEKYVSTNDIGDIISDILKKRI

SEQ ID NO: 7927 - protein, 52 aa, Gossypium hirsutum
MEKLDHIKSHLATLSQIGENEKNGFINLVSRYLSGEAQQIEWSKIQTPTDEV

SEQ ID NO: 7928 - protein, 392 aa, Oryza sativa (japonica cultivar-group)
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 7929 - protein, 316 aa, Oryza sativa
  unsure (1)..(316): unsure at all Xaa locations
WARPCDGCRXAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSMSLHFSSMDREARVLRYREKKKARKFEKTIRYETRKAYAEARPRIKGRFAKRSDVQIEVDQMFSTAALSD

SEQ ID NO: 7930 - protein, 302 aa, Oryza sativa
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 7931 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGANTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 7932 - protein, 395 aa, Corynebacterium glutamicum ATCC 13032
MMSRSPEQHLAEISALLPPQKSTFVNLREALGRRTFSAVTAQWDSPRFDNSQMDGFALGPSHLNGGTFAVGPTIPAGHDPDQWYPRGIEKDIAPIMTGARLPKNTAAIIPVEKTTPGNFDAPQVEIPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLFVAPALNRQPLRHLDARITAPVQGLQDNREQFLRGTISYRNGHVLATPLLGTSSHLLVQAATADCLIRIPARTTVEENDIVKIYPFN

SEQ ID NO: 7933 - protein, 209 aa, Streptococcus mutans UA159
MRKKPIIIGVTGGSGSGKTSVSRAILANFPNAKIAMIEHDSYYKDQSHLTFEERVTTNYDHPLAFETDLLINHLKELIADRPVDIPIYDYTQHTRSEKSYRQEPQDVFIVEGILVLEDQRLRDLMDIKLFVDTDDDIRIIRRIKRDMQERGRSLDSIIEQYTRVVKPMYHQFIEPTKRYADIVVPEGVSNLVAIDLINTKVASILNETH

SEQ ID NO: 7934 - protein, 163 aa, Schizosaccharomyces pombe
MSSPGISDESIKGPKDVRLIHLILSSLGVPSYSQTVPLQLLTFAHRYTQQLIQDSQVYAEHSRGQNAPISVEDVRLAVASQINHSFTGPPPKEFLLELAMERNRKPLPQIQPSYGFRLPPEKYCLTQPNWIVSNETQQNQPKEENSSDSRMEEDKLDFSVKSE

SEQ ID NO: 7935 - protein, 359 aa, Zea mays
MELSPNNSTEQSLLDAQLELWHTTFAFMKSMALKSAIHLRIADAIHLHGGAASLSQILSKVHLHPSRVSSLRRLMRVLTTTNVFGTQQPHSSEPVYTLTPVSRLLIGSQSSQLAQTPLAAMVLDPTIVSPFFELAAWFQHELPDPCIFKHTHGRGIWELTKDDATFDALVNDGLASDSQLIVDVAIKQSAEVFQGISSLVDVGGGIGAAAQAISKAFPHVKCSVLDLAHVVAKAPTHTDVQFIAGDMFESIPPADAVLLKSVLHDWDHDDCVKILKNCKKAIPPREAGGKVIIINMVVGAGPSDMKHKEMQAIFDVYIMFINGMERDEQEWSKIFSEAGYSDYRIIPVLGVRSIIEVYP

SEQ ID NO: 7936 - protein, 215 aa, Methanosarcina mazei Goe1
MKQKTSDKSSRRDFQMKIVFINNKDSFVWNLVDYISYFEKDTLVLPNTVTLEELKEIKPDALVISPGPGNPSDPRDIGNCLEIIREMGREIPLLGVCLGHQAINVAFGGPVRRCKVGPVHGKSSRIRHAESALFTTLEEKFEAGRYHSLEIGDPAPGIKVTALAEDGTIMAVEHSEFPIYGLQFHPESVLTPDGLKIIERFLEISRDFKKRQPAV

SEQ ID NO: 7937 - protein, 84 aa, Oryza glaberrima
ARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 7938 - protein, 448 aa, Grinnellia americana
LALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQSMGIWARKNDMILHLHRAGNSTYSRQKIHGMNFRVICKWMRMAGVDHIHAGTVVGKLEGDPLMIRGFYNTLLLPNLDINLPQGIFFKQDWAALRKVTPVASGGIHCGQMHQLLDYLGNDVVLQFGGGTIGHPDGIQAGATANRVALESMVIARNEGRDYVAEGPQILRDAAKTCGPLQTALDLWKDITFNYTSTDTADFVETPTANV

SEQ ID NO: 7939 - protein, 440 aa, Pseudomonas syringae pv. syringae B728a
MALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSASGSEIGISNLWAHGGFMPNGVTGLIASFAVVMFAFGGIEIIGITAGEAKDPRRSLPQAINAVPLRILLFYVLTLFVLMCIYPWPQIGTQGSPFVQIFDNLGIASAATILNIVVISAAVSAINSDIFGAGRMMYGLAREGQAPASFARVSRHGVPWMTVLVMGIALLGGVLLNYLIPKDVFLLIASLATFATVWVWLMILLTQVSMRRSMSREEAAQLKFAVPFWPYGPAAAIAFMLFIFGVLGYFPDNRAALIVGAIWIVLLLIAYAVWVKPKALNTTH

SEQ ID NO: 7940 - protein, 459 aa, Mazzaella japonica
DPDYVVKDTDVLALFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKQLGSIIVMIDLVIGYTAIQSMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANI

SEQ ID NO: 7941 - protein, 374 aa, Chlamydomonas reinhardtii
MAAMMQKSAFTGSAVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMNIDLVIEGTGVFIDKVGAGKHIQAGASKVLITAPAKDKDIPTFVVGVNEGDYKHEYPIISNASCTTNCLAPFVKVLEQKFGIVKGTMTTTHSYTGDQRLLDASHRDLRRARAAALNIVPTTTGAAKAVSLVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEWGYSQRVVDLAEVTAKKWVA

SEQ ID NO: 7942 - protein, 155 aa, Lilium longiflorum
MGSKLTREEYDTLLAAFHKLTVRLEVASVPKDATPADIKNLPDAYLYFIDMPGVRTGEIKVEVEDDSALVIIGERKREEEEKYQMMERWTGKRMRKFELPENADTKAVSAVWKNGVLAVTVRKLPAWEVAGISFNIERLPVPLPTKTKSIEVKIA

SEQ ID NO: 7943 - protein, 142 aa, Zea mays
  unsure (1)..(142): unsure at all Xaa locations
MGNPEKLMNQIXDLKFTSKSLQRQARKCEKEEKEQKLKVKKAIEKGNMDGARIYAENAIRKRTEHMNYLRLAFRLXAVVARLDTQAKMQVIGKSMQSIVKSLDSALATGNLQKXMSETMDNFERQFVTLEVQAELMEGAMAG

SEQ ID NO: 7944 - protein, 537 aa, Neurospora crassa
MGLSIGNRILRKIVKNEAMAEDPPEIYGWRVYLLACSACFGAMSFGWDSSVIGGVIELEPFKHDFGFIGNDKAKANLGANIVSTLQAGCFLGALIASPITDRFGRKWCLIAVSLVVIIGIIMQAAASGNLAPMYIGRFVAGVGVGAASCINPVFVSENAPRSIRGLLTGLYQLFIVTGGMIAFWINYSVSLHFKGKSMYIFPLAIQGLPAGLLCVCMLLCHESPRWLARRDRWEECKSVLARIRNLPPDHPYIVDEFREIQDQLEQERRLQGDATYWDLTRDMWTVAGNRKRALISIFLMICQQMTGTNAINTYAPTIFKNLGITGTSTSLFSTGIYGIVKVVSCVIFLLFLADSLGRRRSLLWTSIAQGLAMFYIGLYVRISPPIDGQPVPPAGYVALVCIFLFAAFFQFGWGPACWIYASEIPAARLRSLNVSYAAATQWLFNFVVARAVPTMLVTVGPHGYGTYLIFGSFCLSMFVFVWFFVPETKGISLEHMDELFGVTDGPAAEKSSVHGGDDVGSEMGKGDQKSKHVEVYV

SEQ ID NO: 7945 - protein, 249 aa, Oryza sativa (japonica cultivar-group)
MGRGRVELKRIENKINRRVTFAKRRNGLLKKAYELSVLCDAEVALIIFSNRGKLYEFCSTQSMTKTLEKYQKCSYAGPETAVQNRESEQLKAGRNEYLKLKARVENLQRTQRNLLGEDLDSLGIKELESLEKQLDSSLKHVRTTRTKHLVDQLTELQRKEQMGSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 7946 - protein, 332 aa, Synechocystis sp. PCC 6803
MTTQLDRVVLIGVAGDSGCGKSTFLRRLTDLFGEEFMTVICLDDYHSLDRQGRKAAGVTALDPRANNFDLMYEQIKTLKSGQSIMKPIYNHETGLLDPPEKVEPNKVVVIEGLHPLYDERVRELVDFGVYLDISEEVKINWKIQRDMAERGHTYEDILASINARKPDFTAYIEPQKQYADVVIQVLPTRLIEDKESKLLRVRLVQKEGVKFFEPAYLFDEGSTIDWRPCGRKLTCTYPGIKMYYGPDNFMGNEVSLLEVDGRFENLEEMVYVENHLSKTGTKYYGEMTELLLKHKDYPGTDNGTGLFQVLVGLKMREVYEQLTAEAKVPASV

SEQ ID NO: 7947 - protein, 445 aa, Gelidium floridanum
FRITPQPGVDPVEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVEEGPQILRDAAKTCGPLQTALDLWKDISFNYTSTDTADFVETPTANV

SEQ ID NO: 7948 - protein, 448 aa, Rhabdonia coccinea
LALFRVSPQPGVDPIEASAAVAGESSTATWTVVWIDLLTACDLYRAKAYKVDAVPNTSDQYFAFISYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAGTGEVKGHYLNVTAATMEDMYERAECAKQLGSVIIMIDLVIGYTAIQTMGIWARHNDMILHLHRAGNSTYSRQKIHGMNFRVICKWMRMAGVDHIHAGTVVGKLEGDPLMIRGFYNTLLLPYLKVNLTQGIFFEQDWASLRKVTPVASGGIHCGQMHQLLDYLGVDVVLQFGGGTIGHPDGIQAGATANRVALESMVLARNEGIDYVAEGPQILQDAAKTCGPLQTALDLWKDISFNYTSTDTADFVETPTANV

SEQ ID NO: 7949 - protein, 388 aa, Azotobacter vinelandii
MLRDELSGQHVSTWERRWRPGRWISRRVCRAPATARRCGACPRPASWGCPMATPRPWRVRMSLSVPYPAEFARQLLLDMLRIRYLEERAAELYGEGKIRGFLHLYIGQEAIAVGVLHALASDDAVVATYREHGHALLKGVPMRAIVAEMYGCREGCSRGRGGSMHLFDAKTRFFGGNAIVGGSLPLAVGLALAERMRDGKRLTACFFGEGALAEGAAAESLNLAALWRLPVLFCCENNLYAMGTSLARSQAQTDLCAKVHAFKVPARSVDGMDVVAVHEATRAALGQMQAGCGPCFLEFRTYRFRARSMADPEPCRDKAEVEAWKKRGPIHTYGAQLEAQGLLDEAGRRALEAEAAAEVEAAVAFAEAGSLEPVEDLLRDVYASDWTQ

SEQ ID NO: 7950 - protein, 464 aa, Triticum aestivum
MNLAAPVSTSTSTAVPPHAHGLMPLNLASASSSSLRRSLFASLRKKISPMASAPASASAALSTAAPADNGAAKPAEQRPVQVAKRLEKFKTTIFTQMSMLAVKHGAINLGQGFPNFDGPDFVKEAAIEAIKAGKNQYARGYGVPELNSAVAERFLKDSGLQIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKK

SEQ ID NO: 7951 - protein, 447 aa, Zea mays
MRPPPPSLPSLRSSVLVLVLLPLLAACSSPASGRAVPLSPGTASVAPAPPPVVIIVERRNRFHRELVVASALASIAIAAIILSALYAWVLWRRSRRLPRGNKGARSAHTARGIMLAPILSKFNSLKTSRKGVVAMAMIEYPSLEAATGKFSASNVLGVGGFGCVYKAVFDGGVAAAVKRLEAGGPECEKEFENELDLLGRIRHPNIVSLLGFCVHEGNHYIVYELMEKGSLDTQLHGASHGSALTWHIRMKIALDMARGLEYLHEHCSPPVIHRDLKSSNILLDSDFNAKISDFGLAVTSGNIDKGSMKLSGTLGYVAPEYLLDGKLTEKSDVYAFGVALLELLMGRKPVEKMSQTQCQLIVTWAMPQLTDRTKLPNIVDPVIRDTMDPKHLYQVAAVAVLCVQPEPSYRPLITDVLHSLVPLVPVELGGTLRVAEPPSPNLKHSAC

SEQ ID NO: 7952 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKRPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDA

SEQ ID NO: 7953 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPHWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPSSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 7954 - protein, 86 aa, Triticum aestivum
  unsure (1)..(86): unsure at all Xaa locations
MAATIQSVKARQIFDSRGIPIVEVDVSCLYGTFVRGAVPSGVXTGVYEALELIDGGSHYLGKGVCNAADNVYLIIVPACIGLDPIA

SEQ ID NO: 7955 - protein, 178 aa, Glycine max
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 7956 - protein, 245 aa, Zea mays subsp. huehuetenangensis
SIRNNPVQNKLMNGEDPINNNHAQTAGGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPDPQSDVPVQVPVPPPIRDSIVGYFSAPAADDDASVGNGFLRLQAQEPASMVVGATLSATEMNRVAAATHCAGAMELIQTAMG

SEQ ID NO: 7957 - protein, 454 aa, Rhodospirillum rubrum
MIPRPSIRPFEQPCRRHRLQRSRRSFPARGGGNSPHALLGSHRLRDRSPSQATSSRATPSACVAQRQRGRSRQARTRRDLPAPTPSGAAAPRPGEPLFRRDRRARSRAPGKARPYGGYDMAVRVAINGFGRIGRLVLRALVESGRKDVEVVAINDLGSPEANAHLIKFDSVHGVLPGDVSVSGDVMTIAGTPVKVLAERDPTKLPWGDLNIDIVMECTGIFSDREKAKVHLEAGAKRVLVSAPSNGADLTVVYGVNHDKLTKDHLVVSNASCTTNCLAPVAQVLHSVFGIEHGFMTTIHSYTGDQRTVDTLHKDLHRARAAAVSMIPTTTGAAKAVGLVLPELAGKLDGTSIRVPTPNVSVVDLKVVLSKTATAEAIGAAMKEAAAGKLKGVLGINELPLVSIDFNHNKNSSTFDLPQTKVVQGTFARVLSWYDNEWGFSNRMLDTAVEMGKLI

SEQ ID NO: 7958 - protein, 94 aa, Glycine max
  unsure (1)..(94): unsure at all Xaa locations
MSIASMRMATIGSIKARQIFYRSGNPTVVEDLTCSDGTFDRAAVPSGAYTGIDEALELREGRSDYLGKGXDXAAGNANTAIGPDLIGGGPTEQT

SEQ ID NO: 7959 - protein, 286 aa, Glycine max
  unsure (1)..(286): unsure at all Xaa locations
MASLSCSANDLAPLFNDTAAANYLCAQFDSISRKLAETTYAVDNTYLLFSAYLVFAMQLGFAMLCAGSVRAKNTMNIMLTNVLDAAAGGLSYYLFGFAFAFGGPSNGFIGRHFFGLRDYPMGSSPSGDYSFFLYQWAFAIAAAGITSGXSIAERTQFVAYLIYSSFLTGFVYPIVSHWFWSSDGWASATRSHGNVLFGSGVIDFAGSGVVHMVGGIAVLWGALIEGPRIGRFDRSGRSVALRGHSASLVVLGSFLLWFGWYGFNPGSFLTIAKGYGSGGYYGQWSA

SEQ ID NO: 7960 - protein, 423 aa, Oryza sativa
MAGIRLMPEEPELPQGTPPRPQLPPAFAGAGAVLAGSGSGGGGGLEMASDDERSVAADSWSVRSEYGSTLDDDQRYADAAEVLAAAAASANFPSDTLQGYVVSCSCGVAVRTFYFVHFLVATSLMIAFRIVIKYVERGSARDVFASFVVIGQVGIGSQMRIQIDCVLTKMIKILARLKAQCWGSKVIGMLLIQKILQIFRNMGMLEKYDVMDTMAVWTKKLCIDIINGGTPSGNESINCEVDEKQLSNYPVLDVGTGNGLLLQALAKQGFSNLTGTDYSEGAIELAKNLAARDGFTSINFLVDDILETKLDRKFKIVTDKGTLDAIGLHPDGRIKRVMYWESVSNLVEPGGIVVVTSCNHTKDELVQEVEDFSKTKSGKEHLDEGEGNVPQIFRYIDHVRTYPTIMFGGVEGSQVCTVAFQRV

SEQ ID NO: 7961 - protein, 179 aa, Pseudomonas putida KT2440
MKAKADTPFVALNIAVLTVSDTRTFDTDTSGQMFVDRLSAAGHRLAERVLLKDDLYKIRAQVATWIADDNVQVVLITGGTGFTGRDSTPEAVACLLDKQVDGFGELFRQISVADIGTSTVQSRALAGLANGTLVCCLPGSTNAVRTGWDGILAEQLDARHRPCNFVAHLKQAAACDSRG

SEQ ID NO: 7962 - protein, 502 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 7963 - protein, 763 aa, Pichia capsulata
MKSTIIILSVLAAATAKNISKAEMENLEHWWSYGRSDPVYPSPEISGLGDWQFAYQRAREIVALMTNEEKTNLTFGSSGDTGCSGMISDVPDVDFPGLCLQDAGNGVRGTDMVNAYASGLHVGASWNRQLAYDRAVYMGAEFRHKGVNVLLGPVVGPIGRVATGGRNWEGFTNDPYLAGALVYETTKGIQENVIACTKHFIGNEQETNRNPSGTYNQSVSANIDDKTMHELYLWPFQDSVRAGLGSIMGSYNRVNNSYACKNSKVLNGLLKSELGFQGFVVSDWGGQHTGIASANAGLDMAMPSSTYWEEGLIEAVKNGTVDQSRLDDMATRIIAAWYKYARLDDPGFGMPVSLAEDHELVDARDPAAASTIFQGAVEGHVLVKNENALPLKKPKYISLFGYDGVSTDVNTVGGGFSFFSFDVKAIENKTLISGGGSGTNTPSYVDAPFNAFVAKAREDNTFLSWDFTSAEPVANPASDACIDFINAAASEGYDRPNLADKYSDKLVEAVASQCSNTIVVIHNAGIRLVDNWIEHENVTGVILAHLPGQDTGTSLIEVLYGNQSPSGRLPYTVAKKASDYGGLLWPTEPEGDLDLYFPQSNFTEGVYIDYKYFIQKNITPRYEFGYGLTYTTFDYSELEVDAITNQSYLPPDCTIEEGGAKSLWDIVATVKFTVTNTGDVAAAEVPQLYVGIPNGPPKVLRGFDKKLIHPGQSEEFVFELTRRDLSTWDVVAQNWGLQAGTYQFYVGRSVFDVPLTSALVFTN

SEQ ID NO: 7964 - protein, 312 aa, Escherichia coli
MKVAVLGAAGGIGGALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 7965 - protein, 516 aa, Zea mays
MAKMAMASSRLPALLCLAAVAVAVAAEAAAAAGEGGLRLPRDATFPAAQAERLIRALNLLPKEKEAGPAAGGGDGPSVAPGELLERRVRLPGAPAGVGDLGHHAGYFRLPHTHDARMFYFFFESRGKKKEDDPVVIWLTGGPGCSSELAVFYENGPFTIANNMSLVWNKFGWDTISNIIFVDQPTGTGFSYSSDDRDTRHDEIGVSNDLYDFLQVFFKKHPEFAKNDFFITGESYAGHYIPAFASRVHQGNKANEGIHINLKGFAIGNGLTDPEIQYKAYTDYALEMNLITKSDYERINRFIPPCEFAIKMCGTDGKASCMAAYMVCNNIFNSIMKLVGTKNYYDVRKECEGKLCYDFSNLERFFGDKAVKEALGVGDIDFVSCSTTVYEAMLTDWMRNLEVGIPALLEDGINVLIYAGEYDLICNWLGNSRWVHSMEWSGQKDFVSSCDSPFVVDGAEAGVLKSHGPLSFLKVHNAGHMVPMDQPKAALEMLRRFTQGKLKQEPLPETMALKAAM

SEQ ID NO: 7966 - protein, 182 aa, Oryza sativa
  unsure (1)..(182): unsure at all Xaa locations
PGLQESARGNDKSGSDENYDGGLLFSWAMHQISNHLTTLQVMLPNITEGGSLSFFLXICMYCAMGLGLVGLDFRGLLPPIFEKAVLNLFSKNMGTAVENFQVVLDSHRWVPMPSVGFVANGVVDETSDDVTPPSVLMEHPPLAVFVNGVSAAMNELRPCAPLSLKNVLAEEVVKGLQAVSDS

SEQ ID NO: 7967 - protein, 450 aa, Gelidium rex
  unsure (1)..(450): unsure at all Xaa locations
DVLALFRVTPQPGVDPVEASAAVAGESSTATWTVVWTDLLTACDLYRAKAYKVEAVPNTSDQYFAYISYDIDLFEEGSIANLTASIIGNVFGFKAVKALRLEDMRIPVAXLKTFQGPATGIVVERERMDKFGRPFLGATVKPKLGLSGKNYGRVVYEGLKGGLDFLKDDENINSQPFMRWKERFLYSMEGVNRSIAASGEXKGHYMNVTAATMEDMYERAEFAKQLGTVIXMIDLVIGYTAIQTMAIWARKNDMILHLHRAGNSTYSRQKNHGMNFRVICKWMRMAGVDHIHAGTVVGKLEGDPXMIKGFYNTLLLXHLDXNLVQGIFFEQDWASLRKVTPVASGGIHCGQMHQLLDYLGNDVVLQFGGGTIGHPDGIQAGATANRVALEAMVIARNEGRNYVXEGPQILRDAAKTCGPLQTALDLWKDIXFNYTSTDTADFVETPTANV

SEQ ID NO: 7968 - protein, 479 aa, Streptomyces avermitilis MA-4680
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 7969 - protein, 127 aa, Triticum aestivum
  unsure (1)..(127): unsure at all Xaa locations
ATSVAPFQGLKSTAGLPVSRRSNGASSAAXXNGGRIRCMQVWPIEGIKKFETLSYLPPLSTEALLKQVDYLIRSKWVPCLEFSKVGFIFREHNASPGYXDGRYWTMWNCYVRVTTHTVSTSGRVRST

SEQ ID NO: 7970 - protein, 314 aa, Streptomyces avermitilis MA-4680
MNAPGAGALLVVGDVVTDVVARHRGPLASGTDTAAAIRTVPGGAGANVACWAAHWGWADVRLLGRVGADGAAWHERELTASGVRPRLVVDPDVPTGTVICLVDTGASAERTFLTDSGASLRLAPGDWSNALLDGVVRLHLSGYLLFSEQSRALVAAALESARARGVPVSLDPASAGFLAELGVDRFLALIEGVDVLLPSRDEACLLTGLPDPADAAAKLSRHVPLVVAKQGAEGALVAEAGAVRARVPATPATPRDTTGAGDAFTGAFLAALLVGVEPAQAAAEGCRAGAAAVAGVGGRPPSGTRQNRGAVKLD

SEQ ID NO: 7971 - protein, 512 aa, ASPERGILLUS NIDULANS FGSC A4
MGFMLRKPDDAAGSAAPAILIGLFVAFGGVLYGYDTGTISGILAMKYWRRQFSTGYVNPNDHIPDVTSSQSSMIVSLLSAGTFFGALTAAPVADYFGRRIAMILDCFVFCFGVVLQTAATAIPLFVAGRFFAGFGVGLLSATVPLYQSETAPKWIRGTIVGAYQLAITIGLLLAAIVNNSTKDRNDTGCYRIPVAVQFAWAIILVVGMIILPETPRFLIKQDNHEAAIKSLARLRRLDINDLAVVEELEEIKANHEYELSVGKASYLEILRGSIVTVYYGTTFFQHSGINNSFVITLITNIVNVVSTLPGLWMVEKWGRRPLLLFGAVGMCVSQFIVAIVGTTTDSGVANKVLIAFVCVYIFFFASSWGPVAWVVTGELFPLKARAKCLSITTAANWLLNWAIAYATPYMVDSGPGNANLQSKVFFIWGGFCLIAGIFVWTCIYETKGLTLEEVDELYAKVPVAWRSKGFVPSVHYTDVRDVAAGRKGSGLAELEADAQAKQISEHVEKASV

SEQ ID NO: 7972 - protein, 303 aa, Neurospora crassa
MPLEAVMIVVDNSESSRNGDYIPTRYDAQADAVNIIFQNVVQGNPESSVGLMSMAGRGPEVLVTLTTDQGKILEGLHRTKKNIRGSAQLSRAIQVAWLALKHRQNKSQRGRIVIFVCSPIEEEESDLVKLAKKMKKNNTSVDFVLFGDIDDENQKKLEAFNREVKSGEGSNMVVIPPSSKLLSDQLISTPILLGEAAAGGSGGAGGDAGGAANEDFPFGIDPSVDPELALALRMSMEEEKARQEKRAKEEAEAAKKASLEDVKEEAGESEPLLGKDGEPSGSGSKKDGDKPGKSDDGDKMDTS

SEQ ID NO: 7973 - protein, 217 aa, Cytophaga hutchinsonii
MANVLIAPSVLSADFANLERDVKMINSSKADWFHIDIMDGVFVPNISFGFPVMQAINKHAAKPLDVHLMIVNPEKYIQTFKDSGAANISVHYEACTHLHRTIYQIKDVGCKAGIAINPHTPIHLLKDVIKDIDLVCMMSVNPGFGGQKFIEHTYQKVRDLKQLIQENNANVLIEIDGGVNEVTGPKLVQAGADVLVAGNYVFSAKDPVATIEQLKNI

SEQ ID NO: 7974 - protein, 302 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLAKQLIEDYDCTHASTIAVMRVPHEEVSNYGVIAPQGKAVKGLYSVETFVEKPSPDEAPSDLAIIGRYLLTPEIFAILENQAPGAGNEVQLADAIDKLNKTQRVFAREFKGERYDVGDKFGFMKTSLDYALKHPQVKDDLTDYIIKLGKALESTQQQAK

SEQ ID NO: 7975 - protein, 68 aa, Zea mays
MCAVAFCSGEAEQIEWSKIQTPTDEVVVPYDTLTSPPEDLEETKKLLDKLVVLKLNGGLGTTMGCTGP

SEQ ID NO: 7976 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7977 - protein, 356 aa, Escherichia coli
MSTVTITDLARENVRNLTPYQSARRLGGNGDVWLNANEYPTAVEFQLTQQTLNRYPECQPKAVIENYAQYAGVKPEQVLVSRGADEGIELLIRAFCEPGKDAILYCPPTYGMYSVSAETIGVECRTVPTPDNWQLDLQGISDKLDGVKAVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIVAMRERVAQIIAEREYLIAALKEIPCVEQVFDSETNYILARFKASSAVFKSLWDQGIILRDQNKQPSLSGCLRITVGTREESQRVIDALRAEQV

SEQ ID NO: 7978 - protein, 306 aa, Schizosaccharomyces pombe
KTTLHHFKMGNVQSQEGETRAHAVPSQDATTTPDNANNVPKEPRAQSMISIAADDLNQEGEMSDDNQQEGGNNRTSQNGTSGSSGHTKRRSQTSGKKTHQPYSGPCVPTIIRWRGGGEVVYVTGSFSRWKKKIQLLKSEDYTVLLQLRPGTQRFKFLVDGIWCCSSDFPTATDAEGNLYNYLEVEANEKLGASIDERLSQVHTDLPMEEKSESEQYSTEIPAFLTSNTLQELKLPKPPSLPPHLEKCILNSNTAYKEDQSVLPNPNHVLLNHLAAANTQLGVLALSATTRYHRKYVTTAMFKNFDV

SEQ ID NO: 7979 - protein, 337 aa, Azotobacter vinelandii
MSRVTLSRYLIEQTRSHNTPADLRFLIEVVARACKEISHAVSKGALGGVLGSMGTENVQGEVQKKLDVMSNEILLEANEWGGHLAGMASEEMDSAYQIPGKYPKGAYLLVFDPLDGSSNIDVNVSVGTIFSVLRCPDQYLTQNDSLNEQAFLQPGTQQVAAGYAIYGPQTMLMLTLGNGVKGFTLDRELGSFVLTHDNLCVPETTAEFAINMSNQRHWEPPVKRYVDELLAGKTGPLDKDYNMRWIASMVADVHRILTRGGIFMYPRDAREPSKPGKLRLMYEANPMSFIIEQAGGAATNGTQRILDIQPESLHQRVAVFLGSKAEVERITDYHLEG

SEQ ID NO: 7980 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 7981 - protein, 558 aa, Xanthomonas axonopodis pv. citri str. 306
MWEALGTVRDLGRLQEIASVLIRYGFGDVVRRIGLADVLERAGRLLHWQNAEGRLRMSAAMRVRRALEELGPTFVKLGQVLATRVDLLPPEWIEELSELQNAVPALPFDQIRPQLVAALGMEPESVFARLDEQPLAAASLAQTHRAWLVDGTPVVLKIRRPDIGDTIDADLRLLARLAEIVETRAPDLKRYRPSEVVQQFTVSLRRELDFAAEGRNAERIAANFAHDAQVVVPAVYWEWTSESLNVQEFIDGIPGRDLLAVDAAGLDRRALARAGAGIVLKMVLQDGCFHADPHPGNIFYLRDGRIAVIDFGMVGRVSEQRRFQVAQLLHGMVSYDAEAVIDVLLEWAGTSLEIDEARLQQDIGAFVDEYRGVPLKELRIGAMLGDVTSILRDHGLTLPSDLALMIKAFLTLEGMGRQLDPDFDMATEARPYLERVVLQRYAPRAIVRRGRRTVTGAIDLIGDLPRDLKRLLQAARRGKLQLQVETRALREFGEQVDRAANRLTMGIVTAALVIGSSIVMNSVGGSASRWLLALGVGGFIGAALCGIWILFSIWRSRR

SEQ ID NO: 7982 - protein, 157 aa, Glycine max
MQGLRRCSNDVVQLDLSTPTTTTTTTTTTSSCSLSIDVDESTEARIQRLISEHPVIIFTRSSCCMCHVMKKLLATIGVNPTVIELDDHEIAALPFPDNNHRNPIPAVFIGGDSVGGLESLVALHVSGHLVPKLVQVGPSGCDNNIIIIIITIIIIIS

SEQ ID NO: 7983 - protein, 394 aa, Desulfovibrio desulfuricans G20
MYEFPRMHRLPPYVFAVVGELKMQLRRQNVDIVDMGMGNPDMPTPQHIVEKLNEAAAKGVNHRYSVSRGIPNLRKAICEWYMRKFDVYLDPDKEAVVTMGAKEGLSHLALAMLSPGDVVFAPDPTYPIHTYAAIIAGADVRRIPIGKGRDFFEDLLAATRQTWPQPKLLMLSYPHNPTTELATLEFFQKVVDFAKEHKMYVVHDMAYADLAFDGYEPPSFMQADGAKDVGVEFYSMSKSYSMAGWRVGFCVGNREMVHALTRIKSYLDYGIFQPIQIAATVALNGPEDCVKEIVDTYRQRRDVLCEGLNRVGWPIEPPKATMFAWAEIPEPFRQMGSVEFSKLLLREAGVAVSPGLGFGHFGDHHVRFALIENPHRIKQAIKGIKRVLSGSSCG

SEQ ID NO: 7984 - protein, 244 aa, Triticum monococcum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 7985 - protein, 670 aa, Glycine max
MAHFEKDEVPMLSETHARLSDEVVDSNFRRLVSRTRSASISIPMASLESYEKETSLVGHTGPLCSVRKTPFVQMSGPLYATNGTGNLSRQNIVATRTKVVESKTEKFSTFNGTDENRWDNDYHRKNEHFMRSGQLGLCKDPYSTTSPTYFKASQPTTRRTSAIFDPKYRLAYVSPESRVVGAGDLLDHPKRIALHYLRGYFLIDLFVVLPLPQIMILFVLPKYLGLSGANYAKNLLRAAILVQYFPRLFRFLPLLIGQSPTGFIFESAWANFIINLLIFMLSGHVVGSGWYLFGLQRVNQCLRNACRDSNITGCSAFIDCCYGADDVSGRAEVWNNNVNATACLNSSSDAFKYGIYVNAVPLTIETRVVHKYVFALFWGFQQISTLAGNQTPSYFVWEVLFTMAIIGLGLLLFALLIGNIQNFLQALGRRRLEMQLRGRDVEQWMSHRRLPEDLRRRVRQAERYSWAATRGVNEEMLLENLPEDLQTDIRRHLFKFVKKIRLFALMDEPILDAICERLRQKTYIKGSKILSQGGLVEKMVFVVRGKLESIGEDGTRIPLSEGDSCGEELLTWYLEHSSVSTDGRKVRLPGQRLVSNRTVRCLTNVESFSLSASDIEEVTILFTRFLRSPCVQGALRYESPYWRSLAATRIQVAWRYRKKRLSRVNSSPSD

SEQ ID NO: 7986 - protein, 242 aa, Bacillus subtilis subsp. subtilis str. 168
MPYLKRVLLLLVTGLFMSLFAVTATASAQTGGSFFDPFNGYNSGFWQKADGYSNGNMFNCTWRANNVSMTSLGEMRLALTSPAYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDEWLGSYNGVNPLYAHYDWVRYTKK

SEQ ID NO: 7987 - protein, 366 aa, Daucus carota
MAPSTLTALAQEKTLNSRFVRDEDERPKVAYNQFSDEIPVISLAGIDDAARRSEICRKIVEACEDWGIFQVVDHGVDTALIAEMTRLAREFFALPAAEKLRFDMTGGKKGGFIVSSHLQGEAVQDWREIVTYFSYPIRARDYSRWPDKPEGWRSATGEYSEKLMGLGCKLLEVLSEAMGLDKEAITKACVDMDQKVVVNYYPKCPQPDLTLGLKRHTDPGTITLLLQDQVGGLQATRDGGKTWITVQPVEGAFVVNLGDHGHYLSNGRFKNADHQAVVNSNYSRLSIATFQNPAPNATVYPLKIREGEKAVMEEPITFAEMYRRKMSKDIEVANLKKLAKEKLLQDQEWDKAKLQMKPKSADEIFA

SEQ ID NO: 7988 - protein, 217 aa, Ophioglossum pedunculosum
RSGLLKKAYELSVLCDAEVALIIFSGTGKLFEFASSSMKKILERYRKYGGGLHDNSIATRDAEYWRNEVMRMKEHIACLEESQRHLLGENLVSLSVKNLQKLEHQLEIGANRIRTRKTQILLEQIQELQKKEHFLHGENNILKTKLEQLSTRQVPSLGTLIYTSTVTTTSTTSAGAGVEDNAGGHDSMNAMQKMTLHSNFQPATSAQNTLQLGYYPD

SEQ ID NO: 7989 - protein, 676 aa, Solanum tuberosum
MAIQKWLLFLFLHLHVLNIVAQLPDLRFGICGKSGNYTENSTYKNDLNTLLTSLSSKIDKYGFYNASIGQNSDRASVIVLCRGDVELDDCRGCVDNVVQKIAQLCPNQKEVFGGYDGCMLQYSNQSIIDTPSLSVQLFLWNTANASKPEEFNQELGKLLENLRDRAAQGGPLQKYATGTTIGPDIQPIYALVQCTPDLSRQSCFDCLTDAYGTLPQCPCLGKTGGRIIGIRCNFRYEISRFFVDVPLEAPPPAGNDNKTVPTGTENKTPPTGKDDKTTRTIIIIVVSTVTIVILMICIAVILIRRRKRKLVNGIQGTSVDDTSIAESFQYDFSAIRAATDDFSDANKLGEGGFGPVYKGKLQNGQEVAVKRLSADSGQGDLESKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWLSWRNGTTIDFVDPMLKESTGLIRDIMRNIHIALLCVQESVADRPTMAAVVLMLSSFSLSLPMPSGPAFYMHSNITAETSLIKEYNTRMTDSSELAKSKSIGSSRNEASISELYPR

SEQ ID NO: 7990 - protein, 531 aa, Aspergillus niger
MLFRSLLSTAVLAVSLCTDNASAAKHGRFGQKARDAMNIAKRSANAVKHSLKIPVEDYQFLNNKTKPYRVESLPDVHFDLGEMYSGLVPIEKGNVSRSLFFVFQPTIGEPVDEITIWLNGGPGCSSLEAFLQENGRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAGASIYFDRADVKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 7991 - protein, 486 aa, Nocardioides sp. KP7
MINAKLIINGREETSDRTIDVVSPADTRVVLGSVPDATSEQVDEAVQAAATAFPEWSSRPLEERQGALFAAAGAIHDMIEEYAPLLSRENGKILEESHIDLEFASGICGYTAGISAEALADQRIHDAGGTTLIRRRPIGPVAAVTPWNFPVVLSFMKLAPALVAGNTVVLKPSENSPLVLTEVIRALQEHFPPGVLNMVTGGDATGEALVAHPLIRKIGFTGGIDTGRKVMAVAAQDIKRVTLELGGNDPAVVLDDVDLSPETMRRIAKGAFSATGQVCFGLKSIYVPTRIHDRFVEAFHAAVDEIVVGPGDDPRSTMGPLNNAQQKGSVEKILEEARGAGAVVTTLGRKLDTAAWEHGHFMMPSVVTDADPRLAIVEQEQFGPTVPVVRYTELDEVIRLTNRSQFGLAASIWSADEDRAFELGRRLDTGSVFINSHSFSSLDPRAPFGGTKNSGLGREFSPASLDAYTELQTISRRTGPPGPPLS

SEQ ID NO: 7992 - protein, 181 aa, Zea mays; identical to SEQ ID NO: 4212

SEQ ID NO: 7993 - protein, 332 aa, Bacillus anthracis str. A2012
  unsure (1)..(332): unsure at all Xaa locations
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETXEELV

SEQ ID NO: 7994 - protein, 388 aa, Citrobacter koseri
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENAEDIYAGIEWKADSADAEKVIKFLREEMGVKKIRFPEHCGIGIKPCSEEGTKRLVRAAIEYAIANDRDSVTLVHKGNIMKFTEGAFKDWGYQLARDEFGGELIDGGPWVKIKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 7995 - protein, 352 aa, Triticum aestivum
  unsure (1)..(352): unsure at all Xaa locations
MAGGFAGVEAGGGRAEQYEGRITPYFILACIVGSFGGSLFGYDLGVSSGVTSMDDFLIKFFPDVYDRKHAHLHETDYCKYDNQVLTLFTSSLYFAGLVSTFGASYVTKRHGRRGSIMVGAVSFFLGGAVNAAAVNVXMLIXGRVLLGVGIGFGNQAVPLYLSEIAPFKIRGAVNQLFQLTTCLGILVAHVINYFTDRIHPWGWRLSLGLAVLPATAIFVGALFLPETPNSLVERGRLEEARRVLEKVRGTHKVDAEFEDLKVASEAARAVRGTFRNLLAVRNRPQLIIGALGIPAFXQLSGMNSILFYXPVIFXNLGFGSSGGLYSVHQGVHGRRCPVVVDRGAAGCPQWAG

SEQ ID NO: 7996 - protein, 445 aa, Butyrivibrio fibrisolvens
NCGCTYEKLIYAYKAGLVKEETIDEAVTRLMEIRLRLGTIPERKSKYDDIPYEVVECKEHIKLALDAAKDSFVLLKNDGLLPLNKKDYKSIAVIGPNSDSRRALIGNYEGLSSEYITVLEGIRQVVGDDIRLFHAEGTHLWKDRIHVISEPKDGFAEAKIVAEHSDLVVMCLGLDASIEGEEGDEGNQFGSGDKPGLKLTGCQQELLEEIAKIGKPVVLLVLSGSALDLSWAQESNNVNAIMQCWYPGARGGRAIAEVLFGKASPGGKMPLTFYASDDDLPDFSDYSMENRTYRYFKGTPLYPFGYGLGYSKIDYLFASIDKDKGAIGDTFKLKVDVKNTGKYTQHEAVQVYVTDLEATTRVPIRSLRKVKCLELEPGETKEVEFTLFARDFAIIDERGKCIIEPGKFKISIGGQQPDDRSKELMGRECDIFEIELTGSVTEVEY

SEQ ID NO: 7997 - protein, 427 aa, Nicotiana tabacum
MGNSEDGKSCKPEKSSSTAPDQSNIHVYPDWAAMQAYYGPRVAVPPYVNSPVAPGQAPHPCMWGPLQPMMPPYGIPYAGIYAHGGVYAHPGVPIVSRPQAHVMTSSPAVSQTMDAASLSMDPSAKTSGDTNQGLMSKLKGSDGLGMSIGNCSVDNGDGTDHGPSQSDSGQTEGSSDGSNIHTAEVGEKSKKRSRETTPNTSGDGKSRTRSSPQPREVNGATKKETSIAFNPGNIAEKVVGTVFSPTMTTTLELRNPVGTLVKASPTNVSRISPAVPGEAWLQNEREMKREKRKQSNRESARRSRLRKQGEAEELAIRVQSLTSENLGLKSEINNFTENSAKLKLENSALMERLQNKQRGQAEEVTLGKIGDKRLQPVSTADLLARVNNSGPLDRTNKDDEIHENNTSGAKLHQLLDASHRTDAVAAR

SEQ ID NO: 7998 - protein, 682 aa, Lactobacillus gasseri
MNSNLRKKVTLAGLLVSIGIVYGDIGTSPLYVMKAIVNENGGIAHVSREYIVGSISLILWTITLLTTVKYVLIALKATNHGEGGIFSLYALVRKKAKWLVIPALVGGAALLADGTLTPAVTVTTAIEGLKNMKFGNDIPVPNQNSVIMITIVILLFLFSIQRMGTSIIGKTFGPIMLVWFTFLGLTGIMNLSHDWSLLEALNPLLAVKILFSPANKVGVLILGAVFLATTGAEALYSDVGHVGKGNIMGSWPYVFICLALNYLGQGVWILENPNYHAGATDFNPFFEALPSQWKFFAIILATLAAIIASQALITGSFTLVSEASGLKFLPRMKIIYPSTEQGQLFIPSINKMLCAATIGIVFLFRTSEHMEAAYGLAITVTMLMTTVLLFEYLSLRKVNLSLRLVFLLLFGAIETMFLISSLAKFLHGGYVTVIIAAFIGAIMYIWYFGNKIRDKREAENAYVRLDEFTTMLSNLSHDESIPLYATNLVYMAKVKYNKFIKRDMLYSILDKRPKRAHAYWFVTVNVTNEPFTAEYAVNTYGTKNVINVQLYLGFKQQQKVNVYLRQIVHDLIKDGTIESQPQEYTTTPGRDVGDFSFVIVNDVISPQTQLRSYEKFLVEARVWLQNLSSNPASWFGLDYADTVIERVPLILGNQRRQHITRIAPKKFEDIKKKLQAEGELKE

SEQ ID NO: 7999 - protein, 244 aa, Glycine max
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQKEIIRYLYNHQNEDGGWGLHIESHSTMFGSALSYIALRILGEGPEDGEDRAMARGRKWILDHGGLEAIPSWGKFWVTVLGVYEWSGCNPLPPELLFGY

SEQ ID NO: 8000 - protein, 534 aa, Microbulbifer degradans 2-40
MRRLARLTRIIHTFCRYRLDALLKDVEVKSRYKLLLFPFWFYPKPDISRGRALRNSLEELGPIFIKFGQLLSTRPDLIPDDIIEELNYLQDRVAPFSNEEFKRIVEQALGNNTNALFKEFSEKPLASASVAQVHTATLHTGEDVVVKVVRPNIEKIIQKDVALLELLARTIEKLSPEGRRFKLSEVVADYKDTIFDELDLKREAANASQLRRNFEGSPLLYVPAVHWQYCTNKVMVMERIYGIPVTDMEKINAQSTNLKLLAERGVEVFFKQVFEHNFFHADMHPGNVFVSPANPQNPSYMAVDMAIIGSLTKEDQYYLARNLLAMFRRDYRQVAELHVMSGWVPANTSISGFESAIRTVCEPIFERPLKDISFGESLVNLFRTARRYNMPVQPQLVLLQKTLLNIEGLGRQLYPDLNLWDTAHPYLEKWLKERYQVKTLFNNLKYHAPEWLEKFPEVPHLVFNALEKLNNQPANEHKQQISSATQRTNKALTWLGYGTLMAGLAITLATYTAIPQSAIVLIAAGATLLAVTKR

SEQ ID NO: 8001 - protein, 359 aa, Eremothecium gossypii
MGKKIVFNISSEFQLKALLGEGAYGIVCSAVHKPSGEVVAIKKIEPFERTLFSLRTLREIKILKHFQHENIISIYDIQKPASFDTFNEVYIIQELMQTDLHRVIATQPLSDDHIQYFIYQTLRGLKALHGSGIIHRDLKPSNLLLNANCDLKICDFGLARIEHGGAADLEHPQAGMTEYVATRWYRAPEVMLTAAQYTKAIDIWSSGCILAELFMKRPLFAGKDYKHQLMLIFELLGTPQGDDLAAVKSRRAREYIATLPRYRRASLRAVIPHANPLGLDLLQRMLVFDPRRRITAADALRHPYLATYHDPRDEPDGTPIPASFFDFDHHKDKLTTRDLKRMLWDEVFRDTHAPVRPDA

SEQ ID NO: 8002 - protein, 181 aa, Pyrococcus woesei
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKY

SEQ ID NO: 8003 - protein, 175 aa, Glycine max
  unsure (1)..(175): unsure at all Xaa locations
ASSMISSPDATTVNRAGAGMVAPFTGLKSMAGFPTKKTNNDITSIASSGGRVQCMQVWPPDGKKRLETLSYLPHLDDAQLAQEVQYLLRKGCIPCLEFESXHGFAYREHNTSPXYYDGRYWTMCKLPMFGCTDASHVWNELQEANTAYANGFIRIIGFDNARQVHSISCIGYKPP

SEQ ID NO: 8004 - protein, 356 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 8005 - protein, 472 aa, Arabidopsis thaliana
MAIWFARSKTLVSSLRHNLNLSTILIKRDYSHRPIFYTTSQLSSTAYLSPFGSLRHESTAVETQADHLVQQIDEVDAQELDFPGGKVGYTSEMKFIPESSSRRIPCYRVLDEDGRIIPDSDFIPVSEKLAVRMYEQMATLQVMDHIFYEAQRQGRISFYLTSVGEEAINIASAAALSPDDVVLPQYREPGVLLWRGFTLEEFANQCFGNKADYGKGRQMPIHYGSNRLNYFTISSPIATQLPQAAGVGYSLKMDKKNACTVTFIGDGGTSEGDFHAGLNFAAVMEAPVVFICRNNGWAISTHISEQFRSDGIVVKGQAYGIRSIRVDGNDALAVYSAVRSAREMAVTEQRPVLIEMMTYRVGHHSTSDDSTKYRAADEIQYWKMSRNPVNRFRKWVEDNGWWSEEDESKLRSNARKQLLQAIQAAEKWEKQPLTELFNDVYDVKPKNLEEQELGLKELVKKQPQDYPPGFHV

SEQ ID NO: 8006 - protein, 489 aa, Magnetospirillum magnetotacticum
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 8007 - protein, 94 aa, ASPERGILLUS NIDULANS FGSC A4
MSDPSAPTPEAPAPVEHLNIKVTDNNNEVFFKIKRTTTLKKLMDAFCDRQGKQPSTVRFLFDGTRVRPEDTPDTLDMADGDTLEVHQEQIGGGL

SEQ ID NO: 8008 - protein, 477 aa, Polyneura bonnemaisonii
KSDRYESGVIPYAKMGYWEPEYVIKDTDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTASTMEDMYERAEFAKQLGTVIVMIDLVIGYTAIQSMGIWARKNDMILHLHRAGNSTYSRQKIHGMNFRVICKWMRMAGVDHIHAGTVVGKLEGDPLMIRGFYNTLLLPMLEVNLPQGIFFKQDWASLRKVTPVASGGIHCGQMHQLLDYLGEDVVLQFGGGTIGHPDGIQAGATANRVALESIVIARNEGRPYVEEGPQILRDAAKTCGPLQTALDLWKDITFNYTSTDTADFVETPTANV

SEQ ID NO: 8009 - protein, 295 aa, Methanopyrus kandleri AV19
MKTGTWRVKTGFARMLKGGVVMDVTNVEQAQIAEDAGAVAVMVLEKVPADIRAAGGVARMCDPAKIEEIMDHVTIPVMAKCRIGHVAEAQVLEAIGVDMIDESEVLTPADEEHHINKWEFEVPFVCGARNLGEALRRIAEGAAMIRTKGEAGTGNVAEAVRHMRIIRREISELTRLDKEELYGKAKEYGVPFDLVAEVASLGRLPVVNFAAGGIATPADAALMMQLGADGIFVGSGIFKSDRPQEMAEAIVEATAYYDDPEVVAEVSKNLGDEVAMRGLEISEIPEEERMQLRGE

SEQ ID NO: 8010 - protein, 801 aa, Oryza sativa (japonica cultivar-group)
MDGHPSPRSHHQPPPPERDGSFNYDIESMDGGGGAWRGRYESSEVLLRYDDEAGGGPRQPLLRKRTMNTTSQIAIVGANVCPIESLDYEIVENDLFKQDWRSRKKKQIFQYIVLKWALVLLIGMLTGIVGFFNNLAVENIAGLKLLLTSDLMLKQKCRYFTAFLAYGGCNLVLATTAAAICAYIAPAAAGSGIPEVKAYLNGVDAYSILAPSTLFVKIFGSILGVSAGFVLGKEGPMVHTGACIANLLGQGGSRKYHLTWNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIPTYTAQDVVAIIVLGIIGGVFGGLFNFLLDRILRAYSIINERGPPFKILLTMIISIITSACSYGLPWLAPCTPCPADAAEECPTIGRSGNFKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLHMLPLVMLVLLISKTIADSFNKGVYDQIVVMKGLPFMEAHAEPFMRNLVAGDVVSGPLITFSGVEKVGNIVHALRITGHNGFPVVDEPPVSEAPELVGLVLRSHLLVLLKGRSFMKEKVKTSGSFVLRRFGAFDFAKPGSGKGLKIEDLDLTDEELDMYVDLHPITNTSPYTVVETMSLAKAAVLFRALGLRHLLVVPKTPGRPPIVGILTRHDFMHEHIHGLFPNLGKSH

SEQ ID NO: 8011 - protein, 425 aa, Corynebacterium efficiens YS-314 [sequence omitted]

SEQ ID NO: 8012 - protein, 290 aa, Listeria monocytogenes EGD-e
MKVKKAVIPAAGLGTRFLPATKAMPKEILPIVDKPTIQFIVEEAVASGIEDILIVTGKGKRAIEDHFDSVPELENNLREKNKLDLLHLVEETTNINLHFIRQSKPKGLGDAILQAKGFIGNEPFVVMLGDDIVQSKTPCAKQLIDQYEKTHSSVIGVQNVPREETYRYGIIDPDKEVSDRLYNVTGFVEKPNVEDAPSNLAILGRYLLTPEIFKYLETQEAGSGGEIQLTDAINRLNEIQPVFAYDFEGERFDVGDKFGFIETTLKFALKHPEIKDDVRDLIIRLGDELK

SEQ ID NO: 8013 - protein, 81 aa, Pinus pinaster
TVTAYYLSSQGPKHDEIDYEFLGNLSGDPYIMHTNIFAQGLGNREQQFYLLFDPTLAFYTYSVLWTPNHITFSVDGIPVRV

SEQ ID NO: 8014 - protein, 262 aa, Triticum aestivum
  unsure (1)..(262): unsure at all Xaa locations
ARCSRLVPRVNSFVGRIIDDHRSAAPSAAVKDFTDVLLSLQGGDRLADADMTAVLWEMVFRGTDTVAVLMEWVLARXVLHPDVQARVHEELDRAVGRDRAVTESDAASLPYLHAVIKETLRVHPPGPLLSWARLATSDIHVDGFLIPAGTTAMVNMWAITHDPDVWAEPDEFRPERFVAGEFSXVMGSDLRLAPFGAGRRSCPGKSLAMATVAFWLATLLHELEFLPSPDPARGVHLGETLRLSCEMAAPLAVTPRPRRPAA

SEQ ID NO: 8015 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 8016 - protein, 358 aa, Haemophilus somnus 2336
MKSYTIAVLSGDGIGPEIMAEAIKVLDAVQKKYNFKLNYRTFDVGGIAIDNHGTPLPASTLNGCEESDAILFGSVGGPKWEHLPPNQQPERGALLPLRKHFKLFCNLRPAILYQGLEKFCPLRADIAAKGFDMMTVRELTGGIYFGQPKGRDGEGMQTRAFDTEVYYKYEIERIAKVAFETAMKRRKHVTSVDKANVLISSVLWRETVNEVAKNYPDVTLDHIYIDNATMQLIKQPEFFDVLLCSNIFGDIISDEAAIITGSMGMLPSASLNEHGFGLYEPAGGSAPDIAGKGIANPIAQILSAAMMLRYSFNLNEEADSIENAVKQVLSQGYRTADLADEHPPISTAEMGNLIANAI

SEQ ID NO: 8017 - protein, 375 aa, Arabidopsis thaliana
MPLSLQSPPCATLSASIQKGRWKTLAAGFSVTPLPAVNFSLRRSIPRILASASSSSSPSSSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHERLLFKIPATWQGIEAARLLESEGIQTHITFVYSFAQAAAAAQAGASVIQIFVGRLRDWARNHSGDNEIESAIKSGEDPGLALVKRSYNYIHKYGYKSKLMAAAVRNKQDLFSLLGVDYVIAPLKVLQSLKDSPAIPEDEKYSFVRKLTPETATHYHFTNKELVKWNQLSLASSMGPASV

SEQ ID NO: 8018 - protein, 523 aa, Campanula medium
MSIDISTLFYELVAAISLYLATYSFIRFLFKPSHHHHLPPGPTGWPIIGALPLLGTMPHVSLADMAVKYGPIMYLKLGSKGTVVASNPKAARAFLKTHDANFSNRPIDGGPTYLAYNAQDMVFAEYGPKWKLLRKLCSLHMLGPKALEDWAHVKVSEVGHMLKEMYEQSSKSVPVPVVVPEMLTYAMANMIGRIILSRRPFVITSKLDSSASASASVSEFQYMVMELMRMAGLFNIGDFIPYIAWMDLQGIQRDMKVIQKKFDVLLNKMIKEHTESAHDRKDNPDFLDILMAATQENTEGIQLNLVNVKALLLDLFTAGTDTSSSVIEWALAEMLNHRQILNRAHEEMDQVIGRNRRLEQSDIPNLPYFQAICKETFRKHPSTPLNLPRISTEACEVDGFHIPKNTRLIVNIWAIGRDPKVWENPLDFTPERFLSEKHAKIDPRGNHFELIPFGAGRRICAGARMGAASVEYILGTLVHSFDWKLPDGVVEVNMEESFGIALQKKVPLSAIVTPRLPPSSYTV

SEQ ID NO: 8019 - protein, 350 aa, Zea mays
MDQSFGNLGAGAGSSSGGSNSKAAAAAVSSSSFLQLPLSTASPAYYGAPLALLHHAAAAPSSSQQQQQHHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 8020 - protein, 318 aa, Phytophthora palmivora
SKVGINGFGRIGRLVLRAAAKNPEINVVAVNGPFIATKYMEYMLKYDTVHGRFGGELSHDEQNIYVDGKAIRVFNEMNPANIKWGEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEEAVVSSDFIGDSHSSIFDAEAGIALTDDFVKLVSWYDNEWGYS

SEQ ID NO: 8021 - protein, 196 aa, Glycine max
MSASRAPPAANPPDQIMHSMKRQLPFSSMKPPFVAAGDYHRHDAAEAIVVKTPLLKRKSEVADFEADSGDRMTAGFTEAANSPFQTPVSGKTGKGGKSSRLTKGNRVGTQTPGSNIGSPAGSNLTPAGPCRYDSSLGLLTKKFINLIKQAEDGILDLNKAADTLEVQKMRIYDITNVLEGIGLIEKRLQDRIQWKG

SEQ ID NO: 8022 - protein, 557 aa, Xanthomonas axonopodis pv. citri str. 306
MKAILRASRIGRVILRYRLDALLEGTPAERWLRLAKPFVPRASAEIAAQSRGARLRLALQELGPIFVKFGQILSTRRDLIPADVAEELTLLQDRVKPFDGQAARLIVEAALGLPVSVAFASFDTVPLASASIAQVHAATLPPDANGVRREVVVKVLRPEIERQIDADIALLHSLATLVERTHPRADKIRPREVVAEIEGTLAAELDLQREGANASVLRRFWEGSDDLYVPEVIWSHTAERALTLERVYGIPSDDIAKLDAAGIDRKALAAKGVRVFYTQVFRDNFFHADAHAGNIWVDSDPERRLNPRFIALDFGIMGQLSQEDQYYLAENFMAIFHKDYRRMAELHVEAGWMPSNVRIDELEAAARSVCEPYFNRPLSEISLAQVLIKLFRVAQRYELTLQPQLILLQKTLLNIEGVGRQLDPRLDIWAVARPVLERILRERYSPRRVLRELSKRLPEIMTHAPDMPRLVYSWLTQQVEGRHQIAIRSPELLALDLSLRKLQTRVVTAITGSGLLVVAAVLYGLHPDGWYLGTVPVWSWISGGAGSAALLVAWLRR

SEQ ID NO: 8023 - protein, 295 aa, Acinetobacter calcoaceticus
MNKKLEALFRENVKGKVALITGASSGIGLTIAKRIAAAGAHVLLVARTQETLEEVKAAIEQQGGQASIFPCDLTDMNAIDQLSQQIMASVDHVDFLINNAGRSIRRAVHESFDRFHDFERTMQLNYFGAVRLVLNLLPHMIKRKNGQIINISSIGVLANATRFSAYVASKAALDAFSRCLSAEVLKHKISITSIYMPLVRTPMIAPTKIYKYVPTLSPEEAADLIVYAIVKRPTRIATHLGRLASITYAIAPDINNILMSIGFNLFPSSTAALGEQEKLNLLQRAYARLFPGEHW

SEQ ID NO: 8024 - protein, 428 aa, Phaseolus vulgaris
PERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLISKAGKPHYVKFHWKATCGEKCLLDEEAVRVGGFNHSHATQDLHDSIAAGNYPEWKLYIQTLDPEQEDKFDFDPLDVTRICPEDVLPLQPVGRMVLNKNIDNFFAENEQLAFCPAIIVPGVYYSDDKLLQTRIFSYADSQRHRLGPNYLQIPANAPKCAHHNNHHEGFMNFMHRDEEVNYFPSRYDPVRHAERIPVPPRILDGKREKCMIEKENNFKQPGERYRSWASDRQERFLRRWVDALSEPRVTHEIRSIWISYWSQADRSLGQKIASHLN

SEQ ID NO: 8025 - protein, 528 aa, Streptomyces coelicolor A3(2)
MDQLALLFMLLLGALLSVPIGARLGLPAPVLMTLLGIVLALLDFVPNVDIPPELILPGLLPPLLYAAVRRTSWRQFAANKRPIFLLAVALVFVTMVCVASVAHAIVPGLPIAAAFALGALVAPPDPVAATAVAGQLGLPRRLVSILEGEGLFNDVTAIVLYHVAIAAAVGGSFSPWRAGFDLVLSAVVAVAIGLVLGWGSNKLMSVLGDPTLQIGLTLLVPFVSYVAADELHGSGVLAVLTTAMFLAEYASDADDVMTRLGGHTVWDVVDTLVTGVAFGLIGLELHNAVRTASGRWTELLGWAAAILVVVVLVRLLWLLPATWLTQRLHARRDQDEDIPTSWRETVVMWWAGMRGVASVALALAIPLETDDGAAFPHREEIVFIAFGVIMGTLLLQGLTLPWLVGRLGVRADTEREQEFERDLALRAAKAAKQRLKEIESVEELPEELSEQMLRRAFDIGIRISPDLGDEERREAQEQRARRIKRVRRIQGEMLSAARHEVLAARSEPGADPEIVDRVLRHLDVRSLR

SEQ ID NO: 8026 - protein, 206 aa, Candida albicans
LFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHA

SEQ ID NO: 8027 - protein, 336 aa, Ralstonia metallidurans
MHTVQMSLWVIGLLVALALLFDFMNGFHDAANSIATVVSTGVLKPHHAVAMAAMCNVIAIFIFHLKVAATVGTGTIDVNIVDHYVIFGALVGAIAWNVITWLYGIPSSSSHALIGGLVGAAVAKAGTGALVGNGLLKTVAFILISPLLGFILGSIMMVIVGWTFFRTPPSRVDRWFRRLQLVSASLYSLGHGGNDAQKTIGIIWMLLIASGHVAVGGAAPPMWVIVSCYLAIGMGTLFGGWRIVRTMGQKITKLKPVGGFCAETGGAITLFIASALGVPVSTTHTITGAIVGVGSAQKMSAVRWGVAGNIVWAWVLTIPASAFMSAIAWWIGKQIL

SEQ ID NO: 8028 - protein, 439 aa, Zea mays
  unsure (1)..(439): unsure at all Xaa locations
MASAGISGSGDDDAGGKLLADRYQKGEVLGEGTYGVVFKAIDTKTGNTVAVKRIWVGKDKKEGVNFTALREIKLLKELKGPNIIELIDCFPYKENLHLVFEFMETDLEALIKDKNIILSPADTKSYLQMLLKGLSFCHKKWVIHRDMKPNNLLIGADGQLKLADFGLARMFGSPGRNFTHQAHEFLLFLHXVFARWYRAPELLFGSKHYGSGVDIWAAGCIFAELLTRRAFLQGSSDIDQLGKIFAALGTPKSSQWPDMVYLPDYVEYQYVAAPPLRTLLPMASDDALDLLSRMLTYDPKARISAQQALEHRYFSSLPAPTRPSQLLRSRWKGDQGNNKMPDLNLQHGPLVLSPPRKLRRVIAHEWMEGMHRADKVDEHPSGMRHTDDMPSQKSSRIPMSVDVGALFGTRPAPRPTLNSADKSRLKRKLDMDPEFGFAE

SEQ ID NO: 8029 - protein, 601 aa, Solanum tuberosum
MWRVARSAASTFRRTRRLSTAISAPCIVHKRGADILHDPWFNKDTGFPMTERDRLGLRGLLPPRVISFEQQYDRFMESFRSLEKNTEGQPDSVVSLAKWRILNRLHDRNETLYYRVLIDNIKDFAPIIYTPTVGLVCQNYSGLFRRPRGMYFSAKDKGEMMSMIFNWPSTQVDMIVLTDGSRILGLGDLGVQGIGIPIGKLDMYVAAAGINPQRVLPVMLDVGTNNQKLLEDPLYLGLRQPRLEGEEYLSIVDEFVEAVHARWPKAVVQFEDFQAKWAFETLDRYRKKFCMFNDDIQGTAGVALAGLLGTVRAQGRPLTDFANQKIVVVGAGSAGLGVLKMALQAVSRMTGPSADPHFFLLDKNGLITKDRKDIDPAALPFAKAHHEIEGLGLQEGAGLAEVVKKVKPHVLLGLSGVGGIFHEEVLRAMKESDSVRPAIFAMSNPTNNAECCPVDAFKLAGEDIVFASGSPFANVDLGNGKIGHVNQANNMYLFPGIGLGALLSGARNISDTMLEAAAECLASYMSDDEINRGILYPSIDDIRDITAEVGAAVLRAAVAEDLAEGHGDVGVKELQHMSKEETIEHVRQNMWYPVYGPLVHE

SEQ ID NO: 8030 - protein, 121 aa, Triticum aestivum
MHLRQQQQQHHRAEMVAPKGCVTVRVGAEGEEQRRFAVPLDHLKHPLFGALLAGAGREYGFRHQGAIAIPCRVDRFVHVERLIDRDLGAHGHQLVDLDCGAATAHGHGHIHLPRFVGCFRA

SEQ ID NO: 8031 - protein, 417 aa, Pseudomonas stutzeri
MDSTALIPVQYGLDTFYFVICGALVMWMAAGFAMLEAGLVRAKNTAEILTKNIVLYALASIMYLLVGYYIMYSSPEGGIFPSLGFLIGDEHAVDLVAAGGEDAPYYSARADFFFQIVFAATCMSVVSGAVAERMKLWAFIAFAVVMTGFIYPIQGFWKWGGGFLDAAGFLDFAGSGVVHMAGAAAALAGVLLLGARKGKYGPNGQINAIPGANMPLATLGAFILWMGWFGFNGGSQLKMSTIEDANAVAQVFVNTNMGAAGGLIAALITARLLFGKSDLTMVLNGALAGLVAITAEPLTPSALQATLIGGVGGVLVVFSILGLDKLKLDDPVGAISVHGVAGMWGLLAVTADQCRRFFRQSSCLGLVSIFLWVFFASLIVWGIIKAVMGLRVSEEEEYEGVDVVECGLEAYPEFTRQ

SEQ ID NO: 8032 - protein, 423 aa, Bacillus subtilis
  unsure (1)..(423): unsure at all Xaa locations
MAQGEKITVSNGVLNVPNNPIIPFIEGDGTGPDIWNAASKVLEAAVEKAYKGEKKITWKEVYAGEKAYNKTGEWLPAETLDVIREYFIAIKGPLTTPVGGGIRSLNVALRQELDLFVXLRPVRYFTGVPSPVKRPEDTDMVIFRENTEDIYAGIEYAKGSEEVQKLISFLQNELNVNKIRFPETSGIGIKPVSEEGTSRLVRAAIDYAIEHGRKSVTLVHKGNIMKFTEGAFKNWGYELAEKEYGDKVFTWAQYDRIAEEQGKDAANKAQSEAEAAGKIIIKDSIADIFLQQILTRPNEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGEELIKNMD

SEQ ID NO: 8033 - protein, 273 aa, Xanthomonas axonopodis pv. citri str. 306
MLERAAAGGDAVSAALLAERLLRGEGVPPQPDAAAQLLQQLQPLGMTALPAVDIAPPDPADDTADHRIAFAPRVGPVRRHTAPRIEEYAAVLSADECRLLMLLARPHLRASKVIDPNDASTQRAPIRTSRGATLDPIIEDFAARAAQARLAACAQLPLAHAEPLSVLCYAPGEQYRAHRDYLPPGTIAADRPTAGNRQRTVCVYLNDVGAGGDTEFPIAGVRVRPRPGTLVCFDNLHADGRPDADSLHAGLPVTAGSKWLGTLWFRQQRYRHW

SEQ ID NO: 8034 - protein, 282 aa, Zea mays
MACSHIVAAAGVSSPAAAAARSPAHSPAAAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEQETFPHDALEATAWTEDGLIMAARHKKYKHIQGVQFHPESIITPEGKKIILNFVRFIEELEKQRS

SEQ ID NO: 8035 - protein, 427 aa, Batrachospermum antipodites
  unsure (1)..(427): unsure at all Xaa locations
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLRGGLDFLKDDENINSQPFMRWRERYLFSMEGVNRAQAATGEIKGHYLNVTAGTMEDMYERAYFAKELGSIICMIDLVIGYTAIQTMSVWARKTDMILHLHRAGNSTYSRQKSHGMNFRVICKWMRMAGVDHIHAGTVVGKLEGDPIMIRGFYNTLLLSHLDINLPQGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNXXSTDTAXXV

SEQ ID NO: 8036 - protein, 289 aa, Ralstonia metallidurans
  unsure (1)..(289): unsure at all Xaa locations
MPLSHRQTLTRYLIEERRRCXPRATRRTQRADPRCGAGMQGAGPRSVSSREXXRATALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKP

SEQ ID NO: 8037 - protein, 340 aa, Taxus baccata
MGSTGKIKIGINGFGRIGRLVARVALQRDDIELVAVNDPFISTESLTSLFKYDSVHGQWKKHEVKVKDEKTLLFGEKHVAVFGCRNPEEIPWGEVGAEYVVESTGVFTDKDKAAAHLKGGAKKVVISAPSKDAPMFVVGVNEHEYKSDLTIVSNASCTTNCLAPLAKVINDRFGIVEGLMTTVHSITATQKTVDGPSNKDWRGGRAAGFNIIPSSTGAAKAVGKVLPVLNGKLTGMCFRVPTQDVSVVDLTVKLEKSATYGEIKAAIKEESEGKLKGILGYTEDDVVSTDFIGDSRSSIFDAKAGIALNDNFVKLVSWYDNEWGYSSRVIDLIVHMDSTA

SEQ ID NO: 8038 - protein, 498 aa, Oryza sativa (japonica cultivar-group); identical to SEQ ID NO: 651

SEQ ID NO: 8039 - protein, 612 aa, Chlamydomonas reinhardtii
MHKYRLVAKKGEGTFSEVLKAQCIKNGKYVAIKCMKNHFDSLDQVNNLREIQALRRLSPHANIIKLLEVLYDQPTGRLALVFELMDMNIYELIRGRRHYVAEERIKNYMYQLMKSMDHMHRNGIFHRDIKPENILIMDDCLKLADFGSCRGIYSKQPYTEYISTRWYRAPECLLTDGYYNYKMDMWGVGCVFFEIVSLFPLFPGTNELDQITKIHNILGTPPPDLLAKMKKRSAHMDFNFPPKEGSGVAKLIPHVNPECVDLIVKLLMYNPDERLSARQALRHPYFRDLREAEKRQKALLAPDVSNHFTAMEADKARQQQTVSSTGSDHEHPTSAGGDGGAGTGAVGTHDGSAAAAAAAAALPSISGARGHAGPEGGHDNDMGGMDASGGGGGGGYGRLPGLAAQSSMASVDGDEASLPPIANLSLGKANMTGSTVGGAAHASTRRSTLNTYYEPGAGGGGGTGGAGGGGGGAGPGPAGYGKVAKAAAVGGAGSVAGGGGVVGGAGVGGGGAVGSGTVGRRQSVGVVVGKYGSVNKQASQGHGGGGPGVAGAAGMAVTGGHAGGGVGGGGGGAVGVGGVGVNKYKANVGKTNSKYISPYSLRQLAGQNAGQG

SEQ ID NO: 8040 - protein, 741 aa, Cytophaga hutchinsonii
MHHLPELITDLALILVTAAITTLIFKKIKQPLVLGYIIAGLLVGPNIKLFPTISEYKNISTWAELGVIILLFSLGLEFSFKKLIKVGGASSITAVFQIVVMLFVGYFAGHLMGWSQMNCFFLGAMLSISSTTIIIRAFEELDVKNKKYASVVFGALIVEDLVAIVLMVLLTTVAVSQQFAGMEMLYSILKLIFFLILWFAGGIYFIPTFLKKSRKLMTDETMLLVALGLCLTMVILADQAGFSPALGAFIMGSILAETTEAEHVEHLIKPIKDLFGAVFFVSVGMMIDPGVLVEYAYPIGILTLVTIFGKAIASTIGALISGQPLKQSVQTGMSLAQIGEFSFIIATLGLSLKVISPFLYPIIVAVSAITTFTTPYLIKYSGSFYGLIERNASPKFLRVIENYGTDTQSIVVLSDWNIFLKSYAINMLLNIVLLIAFGLLSALYIYPFIQEHVINGFNGSVTGIVISFILTVPFLWALTMKQIAPAEYQRLWDNEKKGRSPLILLGVVRLLVGLLSVGFLLSFYLDTALATIISLIVFAVFFFLFSKRLQFLYDRMEKRFLVNFNERDEANDYKAKITPWDAHIIEFKVSPLSPVIGKTLEEMAIREAYGVNIIMIEREYVTLPLPSRTERIYPGDIISVVGSDEQLLKLKEIIACELTADEIETYTLIKNDLVLKNVIVDKDTPLLNRAIKESGIREKRALVVGVERNGERILNPPSTLYFEEGDIVWIAGGSKVIKELF

SEQ ID NO: 8041 - protein, 251 aa, Enterococcus faecalis V583
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 8042 - protein, 503 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 8043 - protein, 177 aa, Streptomyces coelicolor A3(2)
MSANNPFARLPEAASFTVTSTTVADGAAWPSAQRSAGVPGGKDVSPQLSWSGAPEGTRSYAVTVYDPDAPTGSGFWHWAVADIPAAVTELPEGAGDDTGPGLPEGAFQLPNDARAARYIGAAPPAGHGPHRYFVVVHALDVESIGIPADATPAVLGFTMAGHILGRAVLTATAETPA

SEQ ID NO: 8044 - protein, 450 aa, Eremothecium gossypii
MGCSVSTQTLEDENDPFIQDRRANDAIEQNLHQEKQRGKNEVKLLLLGAGESGKSTVLKQLKLLHHGGFTHEERLQYSQVIWADAIQSMKILIIQARKMGISLDCDDPEKNRPLFECKRAVLQAKALDCIDPDMAGGPEFLNDYVLKYSERSENKRRVQSTGKAEAFTPESGAPSSGIDMQELSLGLNEQSGHMGPSGLFVRAQPAAQPLPKRTSNVQVAAAIRKLWDNDRGIRQCFARSNEFQLEDSAAYYFDNIEKFARPDYVCTDEDILRGRIKTTGITETRFNIGASKFNVLDAGGQRSERRKWIHCFQSITAVLFVLAVSEYDQMLFEDERVNRMQEAIMLFDTLLNSKWFYNTPFILFLNKVDLFEDKVKRSPIRQHFPDYPGRVGDAETGLKYFERIFLSLNRSKKPIYVHRTCATDTQSMKFVLSAVTDLIVQQNLKKSGIL

SEQ ID NO: 8045 - protein, 875 aa, Eremothecium gossypii
MADANDSSDSNSTSSFVSALILYGIIGLVYTLIFLALRKRYRRVYEPRTLDDVRTLQPSERVESAPAGYVWWLPHLLYKPHKSLLQHMGVDAYFFARYLAVFGTLALIGCFILLPILLPVNAAGGRHLRGFERISFSNVAMSRRLYAHVFLSWIFFGLVLYVIYRELYYYVSMRQALQTSPYYSSLLQSRTVLFTDVRGGTDAESVLRGAFTGVEEVVYAKDHTELRKLVKERNKTANKYESALNKVVNKSVKVRRKAELKGNTVLQQREDLKDDDFERYVKKRPTHRLGKIPCVGEKVDTLKHCASRLGSLNSRVKSEQEEWETSQPLNTCFVIFSTQRDAQEAYQRAPVALPKGSYDRCIIGCAPDDVNWDSLSMSKSVRRSKRLVGNSILTAMIIFWAIPVAVVGCISNINFLTEKVHFLRFINNLPDVLMGLITSLLPTIMLAVLMSLVPIFIQLVANKTGSISRQETQLYCQRWFYAFQVVHVVLVVMLASSAASTVTAIIDDPNNAFEQLAQNMPLSANFYLSYVMLFAFIFASGVLLQLTGFVLSFILGRILDSTPRQKWTRYNTLNLPTWGVMYPLMELQVCIMLAYAIVTPVLLIISTLALLFAYVAYMYVFNYVYGLKHDYKGRNYVNALFQVFVGLYLAEVFLFALFIMGRAWGPLVLNVIMLAFTVLVHLYLQRRFLPLVDAVPLSLLDGAAGSVGKDQGWAEVVRAGRARPLDGLVALTNRLTGAATPAHPAPVNPDAEKAALSRSAPAAASSALARVKNFFHPSAAYNYDLAKSRLPDTYDKPLEYAEGYTRSAYTDPCIRDKEPVLWVPEDPMGVAARQAAIAEQHGVKVSTSHTGFDEKGAAIYTDNPPDYTPYDYVNH

SEQ ID NO: 8046 - protein, 837 aa, Oryza sativa
MELKPQVASRPHAPKKWQLPSHSQFEPRIIVHLVHKPIQSDVTTPHKYATYKVVSREPGPRCFFRGKVHEASWLRASPYYKRGTRTRRATRFPHLSDSELRRRLCAAAAAALVVCFPNSLIPQRAITMGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVTVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDVAMICIGPRIIFVLGLPLDGRVEEEDGWRCRRHRISWERVDGSGRQERCVVTGEEKLEDRRTHPRPPQLPPAAHALRLSRGEPCLPLRIARQGLSRRDTYTSESLVVLEAHEAAVPACLDKTEAVLSTDPPLTDFQGTLQIDVWFHGRRRAGASWRHANGSSSPFGKRLVPHCHHNKEDVGELWPIVAGGSLLLDMEQRRCNGRRNGGGGSPGRGPTGPWSLLPRCRHTKLLFLPPPSKLLADLLRRCRRARRRPTTISSSSDCPCASLSPRPPPAAARTEGWGGR

SEQ ID NO: 8047 - protein, 490 aa, Escherichia coli O157:H7
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGYGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 8048 - protein, 574 aa, Medicago truncatula
MNLNHSCGFSLTKHTRKTSLTSSIYLRNSHIFLSREFLHVKPLPLSPNIAKNLKNCKLTHPFASLSSFAEAEGEEGSKEEIQLNEHHQHAATENGENNDEVSGMAKAFHISSRTASAITICIVMAALVFPLFMTSLGQGLALKTKMLSYGTLLFGFYMAWNIGANDVANAMGTSVGSGALSLRQAVLTAAVLEFSGALLMGTHVTSTMQKGILVANVFQGKDTLLFAGLLSSLAAAGTWLQFASYYGWPVSTTHCIVGAMVGFGLVYGGAGAVFWGSLARVISSWIFSPLLGAAVSFIVYKCIRRFVYSASNPGQAAAAAAPIAVFLGVTGISFAAFPLSKIFPIALSQALACGTVGAFLVNRTIRKQLGHLLDKSNTPDLEPVPQNISFFSDITGPKGTQLEIVYGVFGYMQVLSACFMSFAHGGNDVSNAIGPLAGALAILQGAAKGADIVIPIDVLAWGGFGIVAGLMMWGYRVIATIGKKITELTPTRGFAAEFAAASVVLFASKLGLPISGTHTLVGAVMGVGFARGFNNVRSETVKEICASWAVTIPVGATLSVIYTWILTKLLSYVL

SEQ ID NO: 8049 - protein, 523 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 8050 - protein, 368 aa, Triticum aestivum
  unsure (1)..(368): unsure at all Xaa locations
MRHWLCCNIRSGDDDDRHEVEHSKAQGNKIDGKQKSSKPADQPEPDISPPTIDVPELSFEDLKEKTDNFGSSSLIGEGSYGRVYHATMDDGRQAAIKKFDASENEPNDEFLKQVSLVSRLKHENLVEMLGYYVEGNYRILAYEFATMGSLHDVLHGRKGVQGAQPGPVLDWMQRVKIAIEAAKGXLEYLLKKGQPSIIHRDIRSSNXAFCFEDFKAKIADFNLLNQAPDMAARLHSTRVLXGTFGYHAPEYAMTGQLTQKSDVYSFGVVLLELLTGRKPVDHTMPRGQQSLVTWATPRLSEDKVKQCVDPRLKGEYPPKGVAKLGAVAALCVQYEAEFRPNMSIVVKALSPLLQQRAAASELAPAPGA

SEQ ID NO: 8051 - protein, 377 aa, Streptococcus mutans UA159
MKIDKYSAILGSAIGFPEMEGLTDTRPLANLPFDGKYRLIDFQLSNLANAGIRSVYGIFRGQNIRSIFDHIRSGREWGLNTLLSHYFLGFYNTPEDSIYADKDYYDQILTYLKRSGSDQTIYMSCDILCNIDLQQVIHLHNANKRNITVVYKKLPINAISAANDILEIDETDTVTGRRDSQSGNETEKMSAGIYIVNTSWLIEQMEKENQKEEPINLRFLLRDLTVAEKALAFEYTGYLANISSIQSYYNANMDMLESQKFYSLLYSNQKVYTKVKNEEATYFAVDSTVKNAQFASGSIIKGTVDHSIISRNCHIANHSRVVNSVVFPKVSIGDGAVVENAILDKNVKIAPGVIIRGTGDKPIVIAKASEVVEDIIQ

SEQ ID NO: 8052 - protein, 426 aa, Chloroflexus aurantiacus [sequence omitted]

SEQ ID NO: 8053 - protein, 380 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLNPCSSASVKAKIMGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSPFSGYGEAAIERNNNGSSEEEVDMNNEFVDPQAEDRELKGQLLRKYSGYLGSLKQEFMKKRKKGKLPKEARQQLLDWWSRHYKWPYPSQKLALAESTGLDQKQINNWFINQRKRHWKPSEDMQFVVMDATHPHHYFMDNVMGNPFPIDHISSTML

SEQ ID NO: 8054 - protein, 359 aa, Buchnera aphidicola str. Bp (Baizongia pistaciae)
MCNILNKIKPGVITGNEALKLFKIAKKNHFAIPAINCINTDSINIVLETAKKAKSPVIIQFSYGGSNFISGPGLTTNILHKKAIIGALSGANHVHIMAKHYNVPVILHTDHCNKNMLPWIDELINVGTKHFKTYNKPLFTSHMIDLSNEKLDYNINICSKYLEKMRKINMLLEIELGCTGGEEDGINNTKINKSLLYTQPNEVNYAYERLSSVGPEFIIAASFGNVHGVYKSGNVRLTPDILKKSQNYVSKKHNLSCNPLCFVFHGGSGSSEKDIKKSIKYGVIKMNIDTDIQWATWQGILNFYNKNNKYLHNQIGNLDNENKPNKKYYDPRTWIRSSQISVSNHLTKIFRILNSCNTL

SEQ ID NO: 8055 - protein, 684 aa, ASPERGILLUS NIDULANS FGSC A4
MEKITHKIAALPPGANYFSLEFFPPKTQMGFANLQARLERMAQALRPLFVTVTWGAGGSTAARSLELAEICQRQLQLTTCLHLTCTNMSRALVDQALEEAKVLGIRNILALRGDPPRSEEYNMHGEDDSNKDFTFAVDLVRYIRKKYGDYFCVGVAAYPEGHPADSFQDIQDPKVDLPWLVEKTQAGADFIMTQLTYDIDAYTEFENLLRNHESGTFKTIPIIPGLMPIHSYKILTRVTKLSHVKIPPPILAKLDEVKHDDDAVKRLGVDILAELVDGMKKLPTPGLRGFHFYTLNLEKTVSFILERCKLIPDHDDDAEAVADGVSLLTVDAEIANRRRRASSISSLPHNRVIVDKVSNGSSKDSVTHEATAASAGLPAGPPDRSTTLQISEGLGALGREATWDDFPNGRWGDARSPAFGEIDGYGPSLHVAPSVAHRIWGYPVSTDDISKLFRRHVSGDLHMVPWSEGGAEENTSGLNAETETIRPELLALIDKKGWWTLASQPAVNGVRSDDPIFGWGPPGEGFVFQKPFVEFFCPASDFKTTLKPLLQKHGHEKLAWFATNAAGDFESSLPAETSDTEPVEMNPNNVNAVTWGVFRGKEIVTPTIIEEVSFRAWGDEAYRIWDEWRRIYPKSSATEKFLEKTKNDVWLVCVVGQDFGAGTEVGSKEEDDEKKWMWRLLADC

SEQ ID NO: 8056 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDAWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 8057 - protein, 734 aa, Neurospora crassa
MATRQMRKLQKQQELLRLKNEAEREDEESEDEPIVTKPKPNAFAGFAAFGGGDDGDDDQDTEEETKEAEDVPEPVAPAKKSKKSKKKKKKGKKTESPAPEKEEEDDLDEIDRVLEELKLKDNKNPVSDIATSNTANSTSQINELLRVNFQHLKAINEMRKLFGSAIEAARAEQAAEANSRQQQRGAARQNVDLETFLSVPPAVQQQLGKRSMFETVLRTNPFIEGKKTWPRDSTRGLKMVRVTESFNGEPGVAEFAFAHDKTYDALEGNFYGLVQMYDPMQLVYFLSRYPYHVSSLIQVSKVAHQDQNSYLAHDLIERALFTFGRVSLSDFRKRLGDGTARLDFNRPENRQFFLAGYNQIKNLVLKGTYRTALEWAKFVLSVNHDDPYGVLNWIHILAIRAYEAKWFIELCNSPLIANLGTGRYVKATLPLAKLQLKDNAGARAAAIESIEELPWLYCALFSALNIDTPRSVWGVQPRDDEEALHTKLYVHLAKDIWNNPAAISLLTEAANAARKVDFFGLPPSPVVSLATARFVYLDNTPELMSAVPRKMLHTASPNFDFDPLPPPKEDNIFSSPTQKMPWSIAEGDGEHRQTRLHEQAQAALQMARARMNEDQLRAVVDDARARIDDPEADEEQRGVWRRIVDVLTGQGWTGGAAGGAEGGEGNQRGDVMPGGWEDDFDDGWGDDDFEDEDHWYEDQLDPELELEFGQGGTPNRRATVEDADDTDEEETARR

SEQ ID NO: 8058 - protein, 198 aa, Triticum aestivum
MGGGKDKHDESDKGLFSNMMHGVAGGHGYPHQGYPPQGYPPPQGAYPPPPGAYPPPPPGAYPPPPGAYPPQHGYPQPGGYPPQSGYPPAGYPGSSHQGYGSSHGGSHMGMGTVLAGGAAAAAAAYGAHKLSHGHSGHGGHGVFGGGYGHGGYGHGYGGHGKFKHGHGGHGKFKHGHGKFKHGKHGHGMFGGGKFKKWK

SEQ ID NO: 8059 - protein, 479 aa, Oryza sativa (japonica cultivar-group)
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 8060 - protein, 355 aa, Chara corallina
LELRDGGKDFMGKGVLKAVSNVNDIIAPALIGKDVTEQTAIDKFMVEDLDGTQNEWGWCKQRLGANAILAVLLAVCKAGAGAKKIPLYQHIANLAGNSKLVLPVPSFNIINGGSHAGNKLAMQEFMILPTGASSFQEAMKIGSEVYHHLKSIIKKKYGQDATNVGDEGGFAPNIQDNKEGLELIKAAIEKAGYTGKVTIGMDVAASEFYSDKTKMYDLDFKTEHNDGSKRITGDQLIQLYESFCSEYPLVSIEDPFDQDDWEHYAKLTALIGEKVQIVGDDLLVTNPKRVAKAIAEKSANALLLKVNQIGSVTESIEAVRMSKKAGWGVMTSHRSGETEDTFIADLAVGLATGQI

SEQ ID NO: 8061 - protein, 169 aa, Escherichia coli
  unsure (1)..(169): unsure at all Xaa locations
SLKLISNDLRDGDKLPHRHVFNGXGYDGDNISPHLAWDDVPAGTKSFVVTCYDPDAPTGSGWWHWVVVNLPADTRVLPQGFGSGLVAXPDGVLQTRTDFGKTGYDGAAPPKGETHRYIFTVHALDIERIDVDEGASGAXVGFNVHFHSLASASITAXFSEGGSHHHHHH

SEQ ID NO: 8062 - protein, 151 aa, Picea glauca
MAMDPLLNTVQQLLVVPDDLERILHAPTRSYMRDTEATASTPVDVKEYPNSYVFIVDMPGLKSNDIKVQVEDENILNISGERKRNEKEEGEVKYIRMERRVGKFMRKFSLPADCNLEAISAACQDGVLTVTVPKLPPPEPKKPKTIAVQIG

SEQ ID NO: 8063 - protein, 384 aa, Petunia x hybrida
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIQRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFADVLGRKPVFPGTECLNQLKLIINILGSQREEDIEFIDNPKARKYIKSLPYSPGTPFSRLYPNAHPLAIDLLQRMLVFDPSKRISVMEALQHPYMSPLYDPNTDPPAQVPINLDIDEDLVEETIREMMWEEILHYHPEAAVALLWKLFYELLLVPSRHRP

SEQ ID NO: 8064 - protein, 198 aa, Glycine max
MFAEENGLKGDPRLQAISQAIRVVPHFPKHGIMFQDITTLLLDHKAFKDTVDIFVDRYRDMHISVVAGIEARGFMFGPSIALGIGAKFVPLRKPRKLPGEVISEKYALEYGTDCLELHVGAAQPGERAIIIDDLVATGGTLSAGVKLLERVGAEVVECACVIGVPDVKGQCRSIGKPLYVLVEPRKADKCQAQADKCY

SEQ ID NO: 8065 - protein, 323 aa, Arabidopsis thaliana
MGEPKDSLALFLCHESESSLNEDDDETIERSDKQEPHFTTTIDDEDYVADLVLKENLRFETLPSKTTSSSDRLIAIDWILTTRTRFGFQHQTAYIAISYFDLFLHKRFIGLQKDETWAMRLLSVACLSLAAKMEERIVPGLSQYPQDHDFVFKPDVIRKTELLILSTLDWKMNLITPFHYFNYFLAKISQDNHSVSKDLVLLRSSDSLLALTKEISFTEYRQFVVAAVTTLLASSSTSSDIRLTREEIANKFGSISWWTSNENENVYLCYQRTLEIEERKHMTPPPEIAVSREPPASGSGAKRRLSFDDSDQSSPPAKRMRRL

SEQ ID NO: 8066 - protein, 385 aa, Solanum tuberosum
HIITAVIGSGVLSLAWAIAQLGWVAGPAVLFAFSFITYFTSTLLADCYRSPGPISGKRNYTYMDVVRSHLGGVKVTLCGIAQYANLVGVTIGYTITASISMVAVKRSNCFHKNGHEASCSIESYPYMIIFAVIQIVLSQIPNFHKLSWLSILAAVMSFTYASIGLGLSIAKASGVGHHVKTALTGVVVGVDVSGTEKVWRSFQAIGDIAFAYAYSTVLIEIQDTLKSSPSESKVMKRASLAGVSTTTLFYVLCGTIGYAAFGNNAPGNFLTGFGFYEPFWLIDFANVCIAVHLVGAYQVFCQPLYGFVEGRCSERWPDSKFITSEYAMQVPWCGTYNLNLFRLVWRTTYVIVTAVIAMIFPFFNDFLGLIGAASFYPLTVYFPVE

SEQ ID NO: 8067 - protein, 454 aa, Glycine max
MASRIVQQQQARGEAVVGGGKQQKKNGVADGRNRKALGDIGNLANVRGVVDAKPNRPITRSFGAQLLANAQAAAAADNSKRQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFYSTLENGKLRVVYRKYSDPQKGAVAVLPPAKFLLPEGSASQHS

SEQ ID NO: 8068 - protein, 506 aa, Glycine max
DRTSFRIEGVEGEFDRICRSLGLSGPEDFAIPAAAWEAMKFRSSSDILPRLKLDNLDIPEEDVEEESKVNEVRMFKSAEEGELSENHGVSDSVRVREIDESSNGIKGIRPPMLKPPPGTRVQVVDDSACSSWDLLRDLAPQGGEGLPLNHSNEEREVAEKEEGEVGTKESPKREEEQNVDNAARIAEIVAGLSESCSFSTSNEDDSSSSTTDPRSNNISPQGRIKRIITAGSWQKGEFLGGGSFGSVYEGISDDGFFFAVKEVSLLDQGTQGKQSVYQLEQEIALLSQFEHDNIVQYYGTEMDQSKLYIFLELVTKGSLRSLYQKYTLRDSQVSAYTRQILHGLKYLHDRNVVHRDIKCANILVDASGSVKLADFGLAKATKLNDVKSMKGTAFWMAPEVVKGKNKGYGLPADMWSLGCTVLEMLTGQLPYRDLECMQALFRIGKGERPPIPDSLSRDAQDFILQCLQVNPNDRPTAAQLLNHSFVQRPLSQSSGSSFPHIHGRKG

SEQ ID NO: 8069 - protein, 645 aa, Glycine max
MFRRSILLISSRPTLRRNPRRFVYQIPLHLSLQKNFSTASKPGVSSASGSPGKPPESNGTLSKFFIGSVALGAAFLAAYQTGYLDQYLKKEHYSVPQEPHVNATIEDLKSVQHSTDQLISPSEKFNHENPTVEITEQKIDAHFSQPEIVVEDQVDKPIPVQDKSDIAEEVTAAAKENQLPEHPQSSLTFDDPSKESVTQSDGIIGIQSTETVNARMEEGYHHASTSTQTSPDENGMKNIQPEQLEIQEMGRRESALGKDIEQQPTLLEEYHLRNKSERSPATYISSHDFTENSHFPEGKEALNGAMEELKDGYISENGKLVLDFLQAIHAAEKRQADLDAHVFSEEKKVLKEKYEKKLKDAAARELMLAEEAAMLDRELKRERAKASLAIKSLQEKMEEKLKTELEQKEIETDLKFKQTQELAKAELNAAIANEKAAQIEKMAEANVNINALCMAFYARSEEARQSHATQNFALRALALEDALSKGLPIETEIASLQSYLGSIDKDSILDLVLASLPEETRSNGTDTQLQLKQKFDALKGSVRHFSFFPPGGGGMLAHSLAHLASWLKVREDDQSGDGIESVINKVEVYLAEGKLAEAADCLEESVRGTQAAEIVAGWVRQARNRAISEQAVLLLQSYANSLSLT

SEQ ID NO: 8070 - protein, 167 aa, Glycine max
QLRRPPPRVSGDVPKSGGISSTPSMRGTVCYIAPEYGGGGQLSEKCDVYSFGVLLLVLVAGRRPLQVTASPISEFERANLISWARQLAHNGRLLDLVDTSIHSLDKEQALLCITIALLCLQRSPGKRPSIKEVVGMLSGEAEPPHLPFEFSPSPPSNFPFKTRKKAR

SEQ ID NO: 8071 - protein, 330 aa, Zea mays
MWRLKIGEGGGPWMQTASDFHGRQVWEYDPDAGTDEERSKVEQLRRAFTENRFRRRESQDLLMRMQFAGQKYVHADLPAATKIEEDGDEVPLTEERLRESLRRALGCMAALQAEDGHWPPGDYSGVMYLMPFWIFALHITGTVDAVLSKEHRREICRHIYNHQNEDGGWGFNVIDESAMFSTCLNYTSLRLLDEVQREENDGLAKGRAWILSHGTATAAPHWAKILLSVIGVYDWRGNNPVVPELWLVPRFLPIHPGRFWCFTRIMYMSIAFLYGKKFVGPITPTILALRDELYSSAYVHIDWSKARNSCAKVCHRSSLTLNYYFIAINY

SEQ ID NO: 8072 - protein, 375 aa, Zea mays
MALMQESSSQDLLQAHDELLHHSLCFAKSLALAVALDLRIPDAIHHHGAGGATLLQILAETALHPSKLRALRRLMRVLTVTGIFSVVEQPPAGGGDDSTVHTSDDEAVVVYRLTAASRFLVSDDVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAATIAAAFPHLKCSVLDLPHVVAGAPSDGNVQFVAGNMFESIPPATAVFLKKTLHDWGDDECVKILKNCKQAISPRDAGGKVIILDVVVGYKQSNIKHQETQVMFDLYMMAVNGVERDEQEWKKIFTEAGFKDYKILPVIGDVSVIIEVYP

SEQ ID NO: 8073 - protein, 195 aa, Oryza sativa
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGFAGHFRSFACSTTIIPTYLRSSHPHFI

SEQ ID NO: 8074 - protein, 166 aa, Zea mays
  unsure (1)..(166): unsure at all Xaa locations
MGFPVGYTEVFLPKLFVQTLSILSFIRTVVFSLFRFLGLSDFLEMDQTWPDYTSNPTRTPELRSPFSALLIREILPVIKFEDVTTTSGEDLPXSCAVCLYEFEGEQEIRWLRNCRHIFHRSCLDRXWMDHDPEDVSSWVETPFXVPDEMAKKSLIKRLWAGVPGGS

SEQ ID NO: 8075 - protein, 403 aa, Nostoc sp. PCC 7120
MSFDWITPADRIQQLPPYVFARLDELKAKAREQGIDLIDLGMGNPDGATPQPVVDAAIQALQDPKNHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALDRIKQAGIRYRPEALVSAPE

SEQ ID NO: 8076 - protein, 404 aa, Zea mays
MVLEATMICIDNSEWMRNGDYAPSRFQAQADAVNLICGAKTQWVQSNPENTVGVMTMAGKGVRVLVTPTSDLGKILACMHGLEVGAEANLAAAIQVAQLALKHRQNKRQQQRIIAFIGSPVKYDKKILETIGKKLKKNNVALDIVDFGESDDEKPEKLEALIAAVNSSDSSHIVHVPPGENALSDVLLSTPIFTGEEGGSGFAASAAAAVATGASGFEFGVDPNVDPELALALRLSMEEERARQEAIAKKAAEDTSNTENINASSSNSDSVMAEAELASNAAAGDKQEQPKDDDDLLQQALAMSMEGGASGSAAVTDSAMAEAGAVDPDLALALQMSVQDANMSSDADMSKVFEDRTFVSSILNSLPGVDPNDPSVKDLLASLHSQGEQEKKEDKSDKTEDEKN

SEQ ID NO: 8077 - protein, 437 aa, Cicer arietinum
NSARVMTLKLGQVTTVVISSADMAKEVLLTHDLITSNRTVPDALSVLNHDQYSLSFMRVSPRWRDLRKICNYQLFSNKTLDSSQALRRRKLQDLLNDIERCSKVGEAVDVGKAAFKTTVNLLSNTFFSVDFVHSAKEAGEYKEIIVSILKEVGVPNVSDFFPMLKFLDLQGIRKRSIVSVKKVLSIFKRFVGERVKMREGTGSIGNDDVLDALLNMSSDGGKIEMDKDEIEHLLLNIFVAGTDTTTYTLEWAMAELIHNPEMMSKLKEELEKTVGKGIPVEETDIAKLPYMQAVIKETFRLHPPVPLLLPRRAEIDVKIGDYVIPKDAQILINAWVVGRDPTKWENPNVFIPERFLDSEIDIKGHHFELIPFGSGRRTCPGLPLAIRMLPLMLGSLVNCFDWKLEDGLNVEDFNKEDEFGITLEKSQPVRIVPTKLY

SEQ ID NO: 8078 - protein, 337 aa, Chaetomium globosum
MAIKVGINGFGRIGRIVFRNAVEHADVEIVAVNDPFIEPKYAEYMLKYDSTHGVFNGTIAVEGSDLVVNGKKVKFYTERDPAAIPWKDTGAEYIVESTGVFTTTEKAGAHLKGGAKRVIISAPSADAPMYVMGVNEKTYDGSAQVISNASCTTNCLAPLAKVVNDKFGIVEGLMTTVHSYTATQKTVDGPSAKDWRGGRGAAQNIIPSSTGAAKAVGKVIPELNGKLTGMSFRVPTSNVSVVDLTCRLQKEASYDEIKAALKEASEGDLKGILGYTEDEIVSSDLNGNPNSSIFDAKAGISLNKNFVKLVSWYDNEWGYSRRVLDLLAYVAKVDASK

SEQ ID NO: 8079 - protein, 129 aa, Petunia axillaris
MSTSNASTSGVRKGAWTEEEDLLLRECIEKYGEGKWHLVPVRAGLNRCRKSCRLRWLNYVRPHIKRGDFSLDEVELILRLHKLLGNKWSLIAGRLPGRTANNVKNYWNTHLRKKLIVPHDQKQESKTKP

SEQ ID NO: 8080 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISEPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYEEIKKAIKEESEGKLKGILGYTEDDVVSTDFVGDNRSSIFDAKAGIALSDKFVKLVSWYDNEWGYSSRVVDLIVHMSKA

SEQ ID NO: 8081 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 8082 - protein, 345 aa, Solanum tuberosum
MDDEMYGFHSTRDDYADKALMSPENLMMQTEYNNFHNYTNSSILTSNPMMFGSDDIQLSSEQTNSFSTMTLQNNDNIYQIRSGNCGGGSGSGGSSKDHNDNNNNNEDYDEDGSNVIKAKIVSHPYYPKLLNAYIDCQKVGAPAGIVNLLEEIRQQTDFRKPNATSICIGADPELDEFMETYCDILLKYKSDLSRPFDEATTFLNKIEMQLGNLCKDDGGVSSDEELSCGEADASMRSEDNELKDRLLRKFGSHLSSLKLEFSKKKKKGKLPKEARQMLLAWWDDHFRWPYPTEADKNSLAESTGLDPKQINNWFINQRKRHWKPSENMQLAVMDNLSSQFFSSDD

SEQ ID NO: 8083 - protein, 631 aa, Chloroflexus aurantiacus
MSSGVLPHCCGSSVIDLVVWNGIAQGCANDRYLWLCLKSSVTDSLWTGVSSMTKPLTGAQIMCEALIREGVEVMFGIPGGAIMPFYYAMWDYRDRLRHVLCRHEQGAGHAAEGYARATGKIGVCIGTSGPGATNLVTPIADAMMDSTPLLAITGQVGSHVLGKDAFQETDITGITMPITKHNYLVKNVDELAYVFKEAIYIATTGRPGPVLIDITKDAMQKTTVPNWDIKLNLPGYKPTYHGNRRQIREAIKLLISAKKPLIIAGHGIIMAGAHRELQEFAERLRIPVITTLHGIGAIPENHPLSIGMPGMHGWVHVNRAIQECDVLFNIGGRFDDRVTGKASTFAPNARIIHVDIDPSEIGKNVRVDVPIVGDARLVLQAFLEDLPPPSELADLHTHASDWMEHIREMQDKHQGKQQYKNRAAMVNMALPPHDVYEALSRTLNARGNYRVVTDVGQHQMWAAQLIDWNHGPRTHITSGGAGTMGFAVPAAMGVAIACPNDTVWAIVGDGGFQMTNQEMATIVQEGLKNVKIAVINNGYLGMVRQWQELFEHKRYSGTPLSGPDFAKLAEAYGWKGLTVERSEDVQDAIDEAHATDGPVLIDFRVEREVNVFPMVPQNKSIGEMILSESQA

SEQ ID NO: 8084 - protein, 248 aa, Populus tremuloides
MGRGRVQLKRIENKINRQVTFSKRRTGLLKKAHEISVLCDAEVALIVFSHKGKLFEYSTDDCMEEILERYERYSYAERQLVATDLDSQGDWTLEYNRLKAKVELLQRNHRNYVGEDLDSMSLKELQNLEQQIETALKHIRARKNHLMSQSISEMQRKEKAIQVQNNMLVKQIKEKEKKDKAVAQPAFWDQQNHGPDASSFLLSQPAGLPLPCLNIGGSYQEEAPEARRNGLGHTLEPIYSFHLGGYGA

SEQ ID NO: 8085 - protein, 391 aa, Xylella fastidiosa Dixon
MLVLQEKSNIACKCAVNQYVRGRSITVPLFLLKNVHIKGDILMFINAYGAHAGDKPLESMQIARRAPGVHDVQIDIHYCGVCHSDIHLVRSEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDPFLTLLKRDGTLTLVGAPATPHPSPEVFNLIFKRRSIAGSLIGGIAETQQMLDFCAKHGIVADIELIRADGINEAYERMMKGDVKYRFVIDNATLAA

SEQ ID NO: 8086 - protein, 401 aa, Zea mays
  unsure (1)..(401): unsure at all Xaa locations
MSGGVEPDTPPGSSSSSSRSGGSTPVGGKPPRHHLTSIRHCASSARIAAASAEFVSKLAAAQAIYPXHEFDVCPSVLLQGLESGTLSLISPTADIRPGFLPVFRXSGSFADIGPKSFMEDEHVCVDNLVEHLGLRGPGIPAPGAFYGVFDGHGGSDAACFVRKNILKFITEDCHFPNSIEKAIRSAFVKADHAIADSQSLDRNSGTTALTVLISGRTLLVANAGDCRAVLGKRGRAFELSRDHKPSCSVEKLRIENLGGTVFDGYLNGQLAVARAIGDWHMKGSKGSACPLTPEPEFREVRLTEEDEFLIIGCDGLWDVMSSQFAVSMVRKELMEHNDPQRCSRELVQEALRRDCCDNLTVVVVCFSDDPPPQIEVPRFRVRRSISMEGLHTLRGALDSNV

SEQ ID NO: 8087 - protein, 146 aa, Brucella melitensis 16M
MKYQKSAEAIAKLSAEQYRVTQENGTERPGTGEYLYNKEPGIYVDIVSGEPLFASSDKYESHCGWPSFTKPIERANVTELTDMSHGMVRTEVRSAHGDSHLGHVFPDGPVDRGGLRYCINSASLRFVPKDRMEAEGYGDYLDQVEG

SEQ ID NO: 8088 - protein, 168 aa, Glycine max
  unsure (1)..(168): unsure at all Xaa locations
MFPYEIKFREFIESTRVDMVVVLWTANTERYSNVVVGLNDTMENLFASLDRNEAEISPSTLYAIACVMENVPFINGSPQNTFVPGLIDLAIKRNSLIGGDDFKSGQTKMKSVLVDFLVGAGIKPTSIVSXNHLGNNDGMXLSAPQPSVEGNFKSMLVTIWQHNPILYT

SEQ ID NO: 8089 - protein, 627 aa, Lotus japonicus
MPAWWNRKPWKNKQEHDDDEDGEYEAEEVEEAPRSGLQFNFMKSPISSARSSDKKKKKKIKDKKKPKSFDEVLYRNSPRTSKDCDGGAAAMEKKGLPLPRPTTPCDQASISGSSLSSSASASFDDHSISPHFNANRGQEEVKFNVRPKSPCSRGPTSPTSPLHQRLHALSLDSPTGGKQDEGTSQCHPLPLPPGSPTSPSAPCNTRANGVLENNTCNLSKWKKGKLLGRGTFGHVYLGFNSENGQMCAIKEVKVFSDDKTSKECLKQLNQEINLLNQFSHPNIVQYYGSELGEESLSVYLEYVSGGSIHKLLQEYGAFKEPVIQNYTRQIVSGLAYLHSRNTVHRDIKGANILVDPNGEIKLADFGMSKHINSAASMLSFKGSPYWMAPEVVMNTNGYGLPVDISSLGCTILEMATSKPPWSQFEGVAAIFKIGNSKDMPEIPEHLSDDAKNFIKQCLQRDPLARPTAQSLLNHPFIRDQSATKVANASITRDAFPYMSDGSRTPPVLEPHSNRSSITTLDVDYATKPALAAVRTLRNPRDSTRTITSLPVSPSSSPLRQHRPTHNSPFFSPPHPSYAMMGQSSYTSNNMHKNPARSNATLTLDPWLETSRYKAHTPPGGSPRMRFI

SEQ ID NO: 8090 - protein, 419 aa, Polyopes polyideoides
ETDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVTEGPQLLQDAAKTC

SEQ ID NO: 8091 - protein, 489 aa, Schizosaccharomyces pombe
MVALVNNMRKITIPSVGGKLVSSGQFQNFIASCILFCCPGIYLAVTGLGAGGGHPDAYHMADVTNSLLYALFTVCGWAGGPILKYLGPRWALALGATGYPIYIGGLWYFDNTGKQGFTIFTGAYEGIAAGLLWASTAYISLSYSCANQKSQFIATQWTILAFGSTVGSFIAFGINYHSTSTGVPMAVYIIFIIIMACAVLLAILFIKSPSDVRKSDGTSALSPSNKTFGQELWGLFEAAKDWRLLCLLPASFASQSTIAWQSHLNSYYFSLRTRSLNNVLFWVIQFFVPYLFTLILDAKALKRRTRGIIGLTIQAVVIMATLSGELGWIVSKHIDLHDTSPDLDWTQRGYGGALVLYLLMGIQYGSSIVSVQWCISLLSSDPDKYARYAGLYKGTQAAGMCVSFGIDAAGVSFLGQGIIYFIFLFVMCASQLIMTSIFGKETDRLSTKEHFTDDKSYIDGVMPSTDTYMNEKTSDELDKKSLPSDQVYV

SEQ ID NO: 8092 - protein, 426 aa, Helicobacter pylori 26695
MLTIKDIHALEVMDSRGNPTIQASVVLSDNTKASAIVPSGASTGKREALELRDNDKTRFLGKGVLRACENVNSVIKHHLIGLEAINQAFVDERLRALDGTPNYANLGANAVLGVSMALARASAKALNLPLYRYLGGANALTLPVPMLNIINGGTHANNSIDFQEYMIMPLGFESFKEALRASAEVYHTLKKLLDGKNQLTSVGDEGGFAPNFSNNVEPLEVISQAIEKAGYKLGEEIALALDVASSELVDENFNYHLKGENKILDSHELVAYYKELVAKYPIVSIEDGLSEDDWEGWAFLSKELGRQIQLVGDDLFVTNASLLQKGIEKNIANAVLIKPNQIGTISETLETIRLAKHHAYQCVMSHRSGESEDSFIADFAVALNTGEIKTGSTARSERIAKYNRLLEIEHELKGGIYIGKELFKHG

SEQ ID NO: 8093 - protein, 583 aa, Xylella fastidiosa Temecula1
MNRSAHSATRNGASWLTHALEAEGVDTLFGYPGGTIMPFYDALVDSRLTHILVRHEQGAALAANGYARASGRVGVCVATSGPGASNLITGIADAMLDSVPMVCLTGQVASSLLGTDAFQELDVFGLTMPIVKHSFLVRSIQDLPSMVQDAFRIAREGRPGPVLIDLPKDVQMTDASHLQDHVSAAVMAPPQAEAAMIIEAAAAIASAEKPVIYGGGGIALADAVNVFRTFVDTTSIPTTLTLRGLGALPHAHPHYLGMLGMHGTRAANMAIQECDLLLVIGARFDDRATGKVNEFAPFARIVHLDADAYEINKLRNADIAVPGNLATTLTALSALLSPSTADPHISSSRYEWHERCIGNRERFGVRYDAPGNDIYAPALLKRLSEMAPVDTIIACDVGQHQMWVAQHCKFEDPRNHLTSGGLGTMGFGLPAAMGAQFAYPERTVVLVSGDGSFMMNVQELTTIARCKLPLKIVLLDNNSLGMVRQWQELFFAERYSEIDLSDNPDFTALVQVFGIPAKRITVRSDVEQGLAYLLAQPGPALLHVQIDARANVWPLVPPNTANSTMLESNPAHVQKETPHAIPA

SEQ ID NO: 8094 - protein, 478 aa, Neuroglossum binderianum
LKNDRYGSGVIPYAKMGYWDPDYVIKETDILALFRVSPQPGVDPVEASAAVAGESSTATWTVVWTDLLTACDLYRAKAYKVDPVPNTSDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSIEAVNRSIAATGEVKGHYMNVTAATMENMYERAEFAKQLGTVIVMIDLVVGYTAIQTMGIWARRNDMILHLHRAGNSTYSRQKIHGMNFRVICKWMRMAGVDHIHAGTVVGKLEGDPKMIKGFYDTLLEPYLAVNLPEGIFFEQDWASLRKVTPVASGGIHCGQMHQLLDYLGNDVVLQFGGGTIGHPDGIQAGATANRVALEAMVIARNEGRDYVKEGPQILRDAAKTCGPLQTALDLWKDITFNYTSTDTADFVETPTANV

SEQ ID NO: 8095 - protein, 427 aa, Burkholderia fungorum
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 8096 - protein, 284 aa, Zea mays
MSSGKRSFFAPKKKATNPFDSDSDDDKPQQRPARASSVPPPDEQRGSSSLFGAGDRGGLFSSAANHHYRNDFRDAGGLEGQSVQELEGYAAYKAEETTRRTRGCVRIAEEMRDTASKTLVTVHQQGQQIHRTHMMAVDIDQDLSRSEKLLGDLGGLFSKKWKPKKNGAIRGPMLTRDDSFIRKGSHLEQRQKLGLADHPPPSNARQFRSEPSSALEKVEIEKAKQDDDLSDLSNILTELKGMAVDMGSEIERQTKAMGDAEKDYDELNFRVKGANTRARRLLGR

SEQ ID NO: 8097 - protein, 340 aa, Streptococcus pyogenes MGAS8232
MTIAIDWDNLGFEYHKLPFRYISYYKNGQWDKGQLTEDATLHISESAPALHYGQQAFEGLKAYRTKDGSIQLFRPDRNAARLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 8098 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFMKMEYLSQVIDETLRLVNISFVSFRQATRDVFVNGYLIPKGWKVQLWYRSVHMDPQVYPDPTKFDPSRWEGHSPRAGTFL

SEQ ID NO: 8099 - protein, 1798 aa, Streptomyces coelicolor A3(2)
MPATRRTARVRRVAAVTVTALAAALLPPLAARADTPPAPPSDAKLAKTAARHDLTREQFYFVLPDRFANGDAGNDRGGLTGTRLTTGYDPTDKGFYQGGDLKGLTERLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPAAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEKSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASATAASTTGTPPAEEVPTAASRDYAVVHYKRADGNYDDWGLYAWGDLADGEATTWPGTHPFTGRDAYGAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYIVHKGDEKDLPTDQALDLKADGHEVWLLSGQEDHLLPQPAGSAAAVDLTTSKAVWIDRNTVAWNGSDGAASTQLLASRTGSITAEGGRLTGDDQQWLRLTKSALTDAQKAKFPHLKESTAWSVDPRDRDRVREALRGQVVAAQRTATGALLAATGVQTAGALDDLYADRATRADLGPVFRHGRPTLSVWAPTAQDVKLEIGDRTVRMRRDDATGVWSVTGPKSWKGKAYRYAVKVWAPTAGEVVTNKVTDPYSLALTTDSERSLVVDLDDRSLAPRGWEHYRKPEAVPLQDAQIQELHIRDFSVADRTADADHRGTYLAFTDKKSDGSRHLRELAEAGTSYVHLLPAFDIATIPERKSEQTTPDCDLAALPAGSEKQQECVTKAAAKDAFNWGYDPYHYTVPEGSYATDPDGTERTVEFRKMVKALNEDGLRVVMDVVYNHTAASGQAKTSVLDRIVPGYYQRLLADGSVANSTCCSNTATENAMMGKLVVDSVVTWAKEYKVDGFRFDLMGHHPKANILAVRKALDELTLRKDGVDGKKIVLYGEGWNFGEVADDARFVQATQKNMAGTGIATFSDRARDAVRGGGPFDEDPGVQGFASGLYTDPNSSTANGTEAEQKARLLHYQDLIKVGLTGNLADYSFTDTHGKEVKGSEVDYNGAPAGYAAAPGDALAYADAHDNESLFDALTFKLPKDTSADDRARMQVLAMATATLSQGPALSQAGTDLLRSKSLDRNSYDSGDWFNALHWNCADGNGFGRGLPPAADNQDKWPYAKPLLGAVEVGCPQITGASAAYRDLLRIRSGEQDFSLATAARVQSRLSFPLSGEDETPGVITMRLGDLVVVFNATPERQEQRVGAAAGTGYRLHPVQAAGADAVVKESAYAAKTGTFTVPARTVAVFQRAG

SEQ ID NO: 8100 - protein, 307 aa, Corynebacterium glutamicum ATCC 13032
MSLPIAQHQNAVKTVVVPAAGMGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 8101 - protein, 212 aa, Oryza sativa (japonica cultivar-group)
MGFPVCCYSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 8102 - protein, 305 aa, Hordeum vulgare
VNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCPAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYEQIKAAIKEESEGNLKGILGYVDEDLVSTDFQGDSRSSIFDAKAGIALNDNFVKLVSWYDNEWGYSTRVVDLIRHMHSTK

SEQ ID NO: 8103 - protein, 816 aa, Pseudomonas syringae pv. syringae B728a
MSQEPLVRDADVAAFRAAVLAKLTYSVGKDPDHAFEHDWFEAVALAARDHMVEHWMDHTRQIYRKVQKRVYYLSLEFLIGRLLYDSLSNLGLLEVAREALTELGVDIERIRLLEPDAALGNGGLGRLAACFMESMSTLGIAGHGYGIRYEHGLFRQGIVDGWQQEQTENWLDFGNPWEFERPEVVYSIGFGGSVDTVPTEAGDSRQVWRPGETVRAIAYDTPVVGWRGKSVNTLRLWRARAVEDLHLERFNAGDHFGAVAEVVRAESISRVLYPNDATEAGQELRLRQEYFFVSASLQDLLRRHLNQHATLTDLSEHAAIQMNDTHPSIAVAELMRQLIDNHNIPWDTAWKITVGTLGYTNHTLLPEALETWSVGLMERMLPRHMQIIYLINAQHIDTLRAKGVDDVNVLRAVSLIEEDNGRRVRMGNLAFLGSHSVNGVSALHTQLMRKTVFAELHKIYPERINNKTNGITFRRWLFQANPKLTEMLVESLGEDVLDNAETRLKELEPFAEKSSFRKQMADQRLHSKRALAAIIHERLGIAVNPAAMFDVQVKRIHEYKRQLLNLFHTVALYQAIRAEPGTDWVPRVKIFAGKAAASYHSAKLIIKLTNDIARTVNNDPTVRGLLKVVFMPNYNVSLAESIIPAADLSEQISTAGLEASGTSNMKFGLNGALTIGTLDGANVEMSEQVGLEHMFIFGMSSQQVEARKQAGEFSAHDDVAASGRLNDVLQAIRGGVFSPDDPNRYVGLIDQLLAYDRFLVCADFDSYWAAQAKVEERWHDSKEWWRSAVLNTARMGWFSSDRTIREYAGDIWKALE

SEQ ID NO: 8104 - protein, 264 aa, Oryza sativa (japonica cultivar-group)
MEREELLEQRATATGPSRDGSATAGRRRRRIAHGAAGDALRVGAMRGGGGGLDFFASRSHAARLVDLITSPWPTRVVTSKHTAPSSHAPRCPRKPRSRVCTGNVVEAVRHECSIMGEIRALHNMDDDEVFAYANRIAAPYDLVMQTKQLGRLPVVQFATGNVATPADAALMMQPGCDGVFVSSGIFKSGDPARRAHAIVQAVTHCRSSRPSTPPPRRPRWHTFAVELCPVCRDREREEEMNGEKERKKNREREIDKWAHRQICL

SEQ ID NO: 8105 - protein, 289 aa, Populus alba
EENWAEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIKPSLAAEYQSQLLSILGIDKDKVEDCSKFLMEFALREHFKLLSNKRKFCSLPG

SEQ ID NO: 8106 - protein, 414 aa, Bacillus anthracis str. Ames
MSLLRDEALKMHKEKQGKIGVYSKVKVQNSTDLSLAYSPGVAEPCLEIYKDESKVYDYTMKGNLVGVISDGTAVLGLGNIGPKAAMPVMEGKALLFKSFAEIDAFPICLNTNNPDKIVEVVKLLEPNFGGINLEDIAAPQCFEIEERLRKSCDIPVFHDDQHGTAIVTIAGLINALKLTNKKIEDVQIVVNGAGAAGIAIVKLLLHMHVKNVILCDTKGIIYEQRPIGMNALKEEIARITNIEQKRGTLAEALIDADVFIGVSAADVVDEDMIRSMNHNPIIFALANPTPEIMPNKAKIAGALVVGTGRSDFPNQVNNVLAFPGVFRGALDVQAKEINEEMKLAAVYAIAELISEEELHVNYVIPNPFDPRVVPHVAYAVARAAVETGVSRKNISMSEIKNNLFRLTKEVNILK

SEQ ID NO: 8107 - protein, 309 aa, Vibrio vulnificus CMCP6
MNHINRVAIIGECMVELKKVNGELQQGFGGDTLNTAVYLSRLTQQSGVSTSYVTGLGQDPFSREMLAAWQDEGINTDMVYLSQDKLPGIYAIETADNGERSFFYWRNDSAAKYWLRDRAILTLAKELCQHQMIYLSGISLAILSQDCREALIKLLALCRSDGVKIAFDNNFRPALWSNVADAQAFYQQILQVTDMAFLTFDDEMLLWGDTHEDQAIERTKGFGVSEIVIKRGGDECFVVTEAGRHAVAPLKIDHVVDTTAAGDSFSAGYLAKRILGGDCQQAAFAGHTVAGHVIQHRGAIIPREAMPTI

SEQ ID NO: 8108 - protein, 222 aa, Aquifex aeolicus VF5
MKLLAPSILAGDWWCIGEQIQATIRGGADILHYDVMDGHFVPNITAGYEILSHIRKRASLPIDAHLMIENPDKYIPKFVEAGANWISVHIENNYHIHRTLQLIKELGAKAGVVVNPGTSLSAIEEALYYADYVLLMSVNPGFSGQKFIERSIERLRILKEMRDRINPSCLIEIDGGIKENNIAEVVRAGADVVVVGSGIFGAKDIEAQTRKLKSLMLSAVSV

SEQ ID NO: 8109 - protein, 459 aa, Zea mays
  unsure (1)..(459): unsure at all Xaa locations
NPSLKKEGHGSPVTTSLPPCHLFGCSSRSLARHQAAGIPISREPVAAAGGGGGGGASGFPSHWPPGWRSASTTSRSASPRRSPPAAAAAAVFVAVASMTSAAVSTRVENKKPFAPPKXEVHVQVTHSMPSHKIEIFKSLDDWARDNILTHLKPVEKCWQPQDFLPDPASEGFHDEVKELRERAKEIPDDYFVCLVXDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKISMPAHLMFDGQDDKLFEHFSMVAQRLGVYTARDYADILEFLVDRWKVADLTGLSGEGNKAQDYLCTLASRIRRLDERAQSRAKKAGTLPFSWVYGREVQL

SEQ ID NO: 8110 - protein, 955 aa, Ipomoea batatas
MSRLSGITPRARDDRSQFQNPRLEIAVPDRTAGLQRTKRTLLVKCVLDETKQTIQHVVTEKNEGTLLDAASIASSIKYHAEFSPAFSPERFELPKAYFATAQSVRDALIVNWNATYDYYEKLNMKQAYYLSMEFLQGRALLNAIGNLELTGEYAEALNKLGHNLENVASKEPDAALGNGGLGRLASCFLDSLATLNYPAWGYGLRYKYGLFKQRITKDGQEEVAEDWLELGNPWEIIRMDVSYPVKFFGKVITGSDGKKHWIGGEDILAVAYDVPIPGYKTRTTISLRLWSTKVPSEDFDLYSFNAGEHTKACEAQANAEKICYILYPGDESIEGKILRLKQQYTLCSASLQDIIARFERRSGEYVKWEEFPEKVAVQMNDTHPTLCIPELIRILIDLKGLSWKEAWNITQRTVAYTNHTVLPEALEKWSYELMEKLLPRHIEIIEMIDEQLINEIVSEYGTSDLDMLEKKLNDMRILENFDIPSSIANLFTKPKETSIVDPSEEVEVSGKVVTESVEVSDKVVTESEKDELEEKDTELEKDEDPVPAPIPPKMVRMANLCVVGGHAVNGVAEIHSDIVKEDVFNDFYQLWPEKFQNKTNGVTPRRWIRFCNPALSNIITKWIGTEDWVLNTEKLAELRKFADNEDLQIEWRAAKRSNKVKVASFLKERTGYSVSPNAMFDIQVKRIHEYKRQLLNILGIVYRYKQMKEMSAREREAKFVPRVCIFGGKAFATYVQAKRIAKFITDVGATINHDPEICDLLKVIFVPDYNVSAAELLIPASGLSQHISIAGMEASGQSNMKFAMNGCILIGTLDGANVEIRQEVGEENFFLFGAEAHEIAGLRKERAEGKFVPDERFEEVKEFIKRGVFGSNTYDELLGSLEGNEGFGRGDYFLVGKDFPSYIECQEKVDEAYRDQKIWTRMSILNTAGSYKFSSDRTIHEYAKDIWNIQPVVFP

SEQ ID NO: 8111 - protein, 295 aa, Bacteroides thetaiotaomicron VPI-5482
MNNIIVGMGEALWDVLPEGKKIGGAPANFAYHVSQFGFDSRVVSAVGNDELGDEIMEVFKEKQLKNQIERVDYPTGTVQVTLDDEGVPCYEIKEGVAWDNIPFTDELKRLALNTRAVCFGSLAQRNEVSRATINRFLDTMPDIDGQLKIFDINLRQDFYTKEVLRESFKRCNILKINDEELVTISRMFGYPGIDLQDKCWILLAKYNLKMLILTCGINGSYVFTPGVVSFQETPKVPVADTVGAGDSFTAAFCASILNGKSVPEAHKLAVEVSAYVCTQSGAMPELPVILKDRLL

SEQ ID NO: 8112 - protein, 334 aa, Mycobacterium tuberculosis H37Rv
MTRTSEGLAAFVVDQLEELYRRMWVLRLLDMALEQLRIEGLINGPLQGGFGQEAVSVGAAAALGEGDVIITTHRPHAQHVGTDAPLGPVIADMLGATAGDLEGADEDAHIADPRAGLPAAIRVVKQSPLLAIGHAYALWLRDTGRVTLCVTQDCDVDADAFNEAADLAAVWQLPVVILVENIRGALSVHLDRYTHEPRVYRRAVAYGMPGVSVDGNDVEAVRDCVANAVVRARAGGGPTLVQAITYRTTDFSGSDRGGYRDLAGSEQFLDPLIFARRRLIAAGTTRGRLDEQERAACQQVADAVAFAKARARPNGGGPISRPTSGWHQQPKTRF

SEQ ID NO: 8113 - protein, 351 aa, Glycine max
  unsure (1)..(351): unsure at all Xaa locations
MPVVTEHMKWRRPRNQFRNPISETDDPITQIPSIIQSSHSKSTISSLLTNNNNKSNRKFSAATFRGFGCTAGSSQKVSVPAVIRSSADWEGKRNRKKNHRRKSNSNGNSGNNTCDDDDVSGGTFVDFQDVSCGPGIGFSTDAASVECAVARKNVSSRGKLDVVEERVTHRERSSYFWRRTVKPESXSFLDDEPDIFAARPGLEPXGTARFYRHVPHPXPDXXSVNIMIIRGRIMMGGRFNSHDQFRDWRLDVDNMSYEQLLELGERIGYVNTGLKEDEMGLNIRKVKPSSSNDTSKHQLDKKCSVCQEEYESDDELGRLKCDHSYHFQCIKQWLVHKNFCPVCKQKVVVRH

SEQ ID NO: 8114 - protein, 219 aa, Glycine max
  unsure (1)..(219): unsure at all Xaa locations
MDSACATLNGRHLAKVSEGIGRNRTSGFWGESTRGSVNTKRFLSVQSCKTSRTNRNLRNSKPGSGIARAVLTSDIDEDSMAFQGVPTFEKPEVDPKSVASIILXGGAGTRLFPLTGRRAKPAVPIGGCYRLIDIPMSNCINSGIRKIFILTQFNSFSLNRHLSRAYSFGNGMTFGDGFVELGEDGTRHRVECEIVGEVEQDENRRRKWETSPTFLFSSF

SEQ ID NO: 8115 - protein, 366 aa, Triticum aestivum
  unsure (1)..(366): unsure at all Xaa locations
VLASWPASREFIHPSTMASDRLAALKAFDETKAGVKGLVDAGVKAVPDIFRHPPDPLPPCTKVAAIPVVDLSGPRSEVVAAVREAARTAGFFQLVNHGVPEAAMSGMLAAVRRFNEEPAEAKRXYYTRDAARRVRYNCNADLLPDPGGXWRDTIYMDXWTGWRRAREEEVLPPACRGVAPKYTAQIRMLGRALFELLSEALGVRRGYLEEEAGCLGTLSVAGHYYPACPEPHLTLGAVRHNDPGFLTVLLQDGVGGLQVLTDVEDGEGNVSAAWADVPAVPGALVVNVGDFLQLVSNDRFRSVAHRVVANSVGPRMSVACFFRAKGATVCAPVVADGGGPPRYRTVTAEELLRSSGKQNGLRDVRL

SEQ ID NO: 8116 - protein, 484 aa, Microbulbifer degradans 2-40
  unsure (1)..(484): unsure at all Xaa locations
MPTYQIYGLGAALVDTEIEVTDLDLKDLRIDKGVMTLVDEARQAQLIRTLSKHVAASKRASGGSAANSIIAASYFGAKTFYSCRVANDENGKFYLNDLAEAGVSYYEKNGEPSGTTGKCLVFITPDAERTMNTFLGISETLSVDDIDEQALAESEWAYIEGYLVTSATGRPAAIKLRELAEAKGVKTALSLSDPAIVNFFKDGLVEMIGDGVDMLFCNEAEALQYTGCDTVETAAEALKQCAKAFAITQGAKGALLFDGEQFITVAAHKVTPVDTNGAGDMFAGAFLYGLTNNMSFQQAGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNIIGLYTVC

SEQ ID NO: 8117 - protein, 147 aa, Triticum aestivum
  unsure (1)..(147): unsure at all Xaa locations
RGRGRGTWFGVRGLVAAGRTYVNRLSLTKACDFXLSKELLPFGGWGESYLSSQDKVCTNLEGNRAHAVNTSWAMLALIDAGQGQKDPACLHRAAKILMNFQSEDGEFPQQDIIGATNHNLMLTYAQFRNIFPIWALGEYYRRVLLVA

SEQ ID NO: 8118 - protein, 312 aa, Salmonella typhimurium LT2
MKVAVLGAAGGIGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTLKKDIQLGEDFINK

SEQ ID NO: 8119 - protein, 489 aa, Salmonella typhimurium LT2
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 8120 - protein, 401 aa, Triticum aestivum
MVLESTMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIVFIGSPVTYDKKVLETIGKKLKKNNVALDVVDFGETDDEKPEKLEALIAAVNSSDSSHIVHVPPGDHALSDVLISTPIFTGEEGGSGFAASAAAAAATGATGYDFGVDPNVDPELALALRLSMEEERARQEAIAKKAAEDNKDHASSSTDAIMAEAELTLNAPADVDADLLKDDDDAQLLQQALAMSMDEGASGSAAVADAAMAEAAADDQDLALALQMSVQDAEVAGQSDMSKVFEDRSFVTSILNSLPGVDPNDPSVKDLLASLHGQGEQEEKKDKEDKPDKPEDGKN

SEQ ID NO: 8121 - protein, 762 aa, Allium macrostemon
MWKLLKMADGGNQWLRTTNNHAGRQIWEFDPNLGTPEEIEAVENAREIYRKNRFKMKHSSDLLMRLQFAKENPAEIGLPQVKLAENENITEEAAAITLRRAMNRYSTLQAHDGQWPGDYGGPMFLMPGLIIALSVTGALNTVLSVEHQHEIRRYLYNHQNEDGGWGLHIEGHSTMFGSVLAYVTLRLLGEGADGGDDQAMQKGRKWILDHGSATAITSWGKFWLSVLGVFDWSGNNPLPPEMYLLPYVLPVHPGRMWCHCRMIYLPMSYIYGKRFVGPVTQTIISLRKELFNVPYDQVDWNAARNQCAKEDLYYPHPLIQDILWTTLHKCVEPILMRWPGGKLRGKALKTVMEHVHYEDENTRYICLGHFSKVLNMLCCWVEDQNSEAFKLHLPRLNDYLWIAEDGMKIQGYNGSQLWDTAYAVQAIIATGFSNEFGTTLKKAYKYVKDSQVLEDCPGDLSYWHRHISKGSWPFSTADQGWLVSDCTAEGLKAALLLSKISPEIVGDPIVANRLYDAVNVILSLKNPGGGFASIELTRSYAWLEIINPAESFGDIVIDYPTAESTSACIQALASFRMLYPGHRRDEIEKCITKGVQFIEKTQEHDGSWYGSWAVCYTNGTWYGVKGLISGGKCYENSHSIRKACDFLLSKQLKSGGWGESYLSCQEKVYTNLEGNRAHAVNTSWAMLALIDAGQAQRDAEPLHRAAKVLINMQMENGEFPQQEIMGVFNRNCMISYSAYRNIFPIWALGEYRTRVLSSSAGH

SEQ ID NO: 8122 - protein, 205 aa, Shewanella oneidensis MR-1
MQEPTQYGFYVDTTKCSGCKTCQVACKDRSDIEVGKQWRRTYEYCGGNWTADGQGAYHQDVFAYYISISCNHCSNPVCVKACPTGAMYKERSTGLVKVNQDLCIGCESCARACPYDAPQIDPQRKVMTKCDGCSDRVAKGLKPSCVMSCPQRALDFGLIAELKQQYGNDSDISGLPSSSITHPNLVLKVHAKSGQRGEIINITEV

SEQ ID NO: 8123 - protein, 367 aa, Oryza sativa (japonica cultivar-group)
MKMKFFTQNEVVLTVKTAKKPYTPPREVHLQVKHSLPPQKREIFDSLQPWAKENLLNLLKPVEKSWQPQDFLPDPSSDGFYDEVKELRERAKEIPDDYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFISHGNTARHAKEYGDLKLAQICGTIAADEKRHETAYTKIVEKLFEIDPDYTVLAFADMMRKKISMPAHLMYDGKDDNLFEHFSAVAQRLGVYTARDYADILEFLVQRWKVADLTGLSGEGRRAQDFVCTLAPRIRRLDERAQARAKQAPVIPFSWVYDRKVQL

SEQ ID NO: 8124 - protein, 168 aa, Oryza sativa
NSCSPFFPSENGEDIQVLRYKHGEKYERHYDYFSDNVNTLRGGHRIATVLMYLTDVAEGGETVFPLAEVILKPRKGDALLFFNLSPDASKDSLSLHAGCPVIKGEKWSATKWIRVASFDKVYHTQGNCTDDNESCEKWAALGECIKNPEYMIGTAALPGYCRKSCNIC

SEQ ID NO: 8125 - protein, 541 aa, Zea mays
MGLGVVAELVRLGVLSSTSDHASVVSINLFVALLCACIVLGHLLEENRWVNESITALIIGLCTGVVILLTTKGKSSHILVFSEDLFFIYLLPPIIFNAGFQVKKKQFFRNFMTITLFGAVGTMISFFTISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 8126 - protein, 480 aa, Photobacterium profundum
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 8127 - protein, 631 aa, Pseudomonas syringae pv. tomato str. DC3000
MSQTNSHAQAGGTAKPIGLLIAAVGVVYGDIGTSPLYTLKEVFQGGYGVEVTHDAILGVLSLIFWSLIWVVSFKYMAFVLRADNQGEGGIMALMALARRASAKHPKLQMMMVVFGLFGAALFYGDSMITPAVSVLSAMEGLELAFDGLDHWIVPMALVVLVGLFLIQRHGTARIGVLFGPVMVVWFLVLGALGVYGIMQSPEVLKAVNPAWGLNFFIIHPGIGVAILGAVVLALTGAEALYADMGHFGRKPISRAWFILVLPALLLNYFGQGALVLGNPETVRNPFYLLAPSWALLPLIGLSTMATIIASQAVISGAFSMTLQAIQLGYIPRMHIQHTSSDAQGQIYIGAVNWALMVGVIMLVIGFESSGALASAYGVAVTGTMLCTTILVSTVMLMLWKWPPLLAVPLLICLLLVDGLFFAANVPKIFQGGAFPVLAGAVLFILMTTWKRGKHLLAERIDEGGLPLPIFIGSIRVQPPHRVQGTAVFLTARSDAVPHALLHNMLHNQVLHEQVVLLTVVYEDTPRVPSAQRFEVESYGEGFYRVILHFGFIDEPDVPAALALCHLAELDFSPMRTTYFLSRETVIPSKMDGMARWREALFAFMLKNANGNLRFFKLPFNRVIELGTQVEM

SEQ ID NO: 8128 - protein, 340 aa, Coprinopsis cinerea
MSQVNVGINGFGRIGRIVLRNALQHGKINVVAVNDPFIDLEYMVYMFKYDSVHGRFKGHVEAKDGKLWVEGKPISVFQEKDPANIPWGSVGADYIVESTGVFTTTEKASAHLKGGAKKVIISAPSADAPMFVVGVNLESYDPKYTVISNASCTTNCLAPLAKVINDKFGIVEGLMTTVHSTTATQRTVDGPSHKDWRGGRAVGNNIIPSSTGAAKAVGKVIPSLNGKLTGLAFRVPTIDVSVVDLVVRLEKPASYDEIKQAVKEASEGPLKGILEYTDEKVVSTDFTGSTSSSIFDAEAGIALNKNFVKLISWYDNEWGYSRRVCDLITYAAAKDKEAGV

SEQ ID NO: 8129 - protein, 110 aa, Oryza sativa (japonica cultivar-group); identical to SEQ ID NO: 6810

SEQ ID NO: 8130 - protein, 175 aa, Zea mays
DKELQCRVFAYADTQRYRLGPNYLMLPVNAPRCAHHNNHYDGAMNFMHRDEEGDYYPSRHAPLRQAAPPTPLPPRPVAGRREKATIRKPNDFKQPGERYRSWDADRQDRFVRRFADSLGHPKVSQELRSIWIDLLAKVCGWHGMPVAHVFSFDLSYSCMIYVRLLCICSATRRWG

SEQ ID NO: 8131 - protein, 182 aa, Methanosarcina acetivorans C2A
MIFMTESTPEIHKKNAKKSFSFALITVSTSRYEKYGDSVSPDEAEDLSGKAMKELLEAAGNNVSFYRLVPDEKNTLLNAISDALDSSADIVITSGGTGLAPKDLTIESVTPLFEKEIPGFGELFRYKSLEDIGTSVILTRASAGVIKGKAVFCLPGSPNAVKLALSEIIIPEAGHIVRHVRE

SEQ ID NO: 8132 - protein, 204 aa, Helleborus orientalis
KRRNGLLKKAYELSVLCDAEVALIVFSTRGRLYEYSNNSVKKTIERYKKASTDSSGSGSVSEVNAQYYQQEASKLRNQIATLQNSNRNLLGEQLSNLNIRELKQIEKKIETGINKIQSKKNELLFAEIEYMQKREADLQNDNMYLRAKISENERTQQHMSLMPGTNDYEVISSGAFDSRNFLQVNLLGSNDTYSRSDQTALQLG

SEQ ID NO: 8133 - protein, 332 aa, Helicobacter pylori J99
MAQNLPTIALLATGGTIAGSGVDASLGSYKSGELGVKELLKAIPSLNKIARIQGEQVSNIGSQDMNEEIWFKLAQRAQELLDDSRIQGVVITHGTDTLEESAYFLNLVLHSTKPVVLVGAMRNASSLSADGALNLYYAVSVAVNEKSANKGVLVVMDDTIFRVREVVKTHTTHISTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVGSGGVTSGEIDDKAYGFITSDNLNPQKARVLLQLALTKTNDKAKIQEMFEEY

SEQ ID NO: 8134 - protein, 468 aa, Pseudomonas putida KT2440
MTQTSPIATDEPHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDGGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPNVVEAFTLVTTVSAVLFMFVWTLILLSYLKYRKDRAALHQASNYKMPGGRFMCYVCLSFFAFILVLLSLEADTRSALVVTPIWFVVLAVTYQLVRSRRHPRTAVRNG

SEQ ID NO: 8135 - protein, 738 aa, Eremothecium gossypii
MDGGSNAIGLLSRLSRRMKKPQQPLTDLTQLYSDVANETITNLGLEERGEIKRAYQGWKALQTHVLYELGRIERSYPQVHLYNSEEMGLQSGVQELYTKLQVHMERVGRLYETEGDRGRQTRSGTTQSGSSGSKAGSIGGTTLLRTLRRPPPAEEASARPGATEPAAAPAREADQFFGFDEDVNLIDLSDEGESPRGGSKNPFITGSPEEEGDGSDYEFNVDDYFNHYLEGDEDETPLGAKLERLSLESSEPPPVLATKARAEPSQSRAPANRGHYRAGPRAASSTASLGNLGRPCSAPTVDGANLSTQAARNAVQPVAAAAASSGNIPAARRARPERRRVKTQVRRPGGGSGHAVSSRYIVYRKSATQKATPVGTPGGTPPLGVKGEPVPNSWPATPCGSPAASLPKDIMRQAYSKVLKEEMEAGIIDSLRGVDKTAAKQIFSEIVVRGDEVHWDDIAGLDSAKNSLKEAVVYPFLRPDLFRGLREPVRGMLLFGPPGTGKTMLARAVATESHSTFFSISASTLTSKYLGESEKLVRALFAVARKLSPSIIFVDEIDSILGSRNNNSEHEASRRIKTEFLVQWSALSNAAAANEANEEDERVLVLAATNLPWCIDEAARRRFVKRQYIPLPEGETRRLQIERLLSKQKHTLTEEGFAELIRLTEGYSGSDITSLAKDAAMGPLRELGDNLLMTPRENIRPIALEDFINSLNYIKPSVSPEGLLQYENWADKFGSSGV

SEQ ID NO: 8136 - protein, 371 aa, Zea mays
MRRHMAPIKEQKHTTSAEQQVMLDAELQLWNHTFGYVKSMALKAAIDLGIPEAIHQHGGTATLPQIVTRVKLHPSKTPCLRRLMRVLTLTGVFGAQEPHDDDGGCDDELVYTLTPASRLLVGSPGQNVGPFLTLMLGPIFVSSFLDLRGWFQHETPDPSPFKMTHGRDIWELAPHDAAFGRLFDAGMVADSSFIMDVVVRECGGVFEGISSLVDVAGGLGGATQTIAKAFPNLECSVLDLPNVVASAPADTAVKYVPGDMFESVPAADAVFLKWIMHDWGDADCVKILKNCKKAIPAQGGKVIILDIVVGAGSSCDRKNVETQCLFDLFIMFINGAERDERQWKKIIFEAGFTSYKIIPVLGIRSIIEICL

SEQ ID NO: 8137 - protein, 393 aa, Geobacillus stearothermophilus
MKLAKRVASLTPSATLAITEKAKELKAAGHDVIGLGAGEPDFNTPQHILDAAIKAMNEGHTKYTPSGGLPALKEEIIKKFARDQGLDYEPAEVIVCVGAKHALYTLFQVLLDEGDEVIIPTPYWVSYPEQVKLAGGVPVYVEGLEQNHFKITPEQLKQAITPRTKAVIINSPSNPTGMIYTAEELKALGEVCLAHGVLIVSDEIYEKLTYGGAKHVSIAELSPELKAQTVIINGVSKSHSMTGWRIGYAAGPKDIIKAMTDLASHSTSNPTSIAQYAAIAAYSGPQEPVEQMRQAFEQRLNIIYDKLVQIPGFTCVKPQGAFYLFPNAREAAAMAGCRTVDEFVAALLEEAKVALVPGSGFGAPDNVRLSYATSLDALETAVERIHRFMEARA

SEQ ID NO: 8138 - protein, 231 aa, Triticum aestivum
  unsure (1)..(231): unsure at all Xaa locations
MGVQEVLSRKSGVIVGDDVLRLFEYAREHKFAIPAINVTSSSTVVAALEAARDAKAPVILQFSQGGAAYFAGKGVSNGDQAASIAGSVAAAHYVRSLAPTYGIPVVLHTDHCAKKLLPWLDGMLDADEAYFKEKGEPLFSSHMIDLSEEPVEWNIETTAKYLKRAAPMKQWLEMEIGITGGEGGXGLTNEDVDNNSLYTQPEDILNIYNTLSPISPYFSIAAGFXNVHGVY

SEQ ID NO: 8139 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 8140 - protein, 406 aa, Zea mays
  unsure (1)..(406): unsure at all Xaa locations
PKWVLLTVFCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKXVINNLFVLITTQFISKPLSEGNKHPLLDXSPLPHVQCLCLVMLAVDYRAASEGPLKGIMGYADEDLVSTDFLGDSRSSIFDAKAGIALNDHFVKLVSWYDNEWGYSNRVVDLIRHMFKTQ

SEQ ID NO: 8141 - protein, 84 aa, Zea mays
MANPEKLMNQIFDLKFTSKSLQRQARKCEKEEKEQKLKVKKAIEKGNMDGARIYAENAIPAAKDKEKVDEDDLSRRLAELKARG

SEQ ID NO: 8142 - protein, 394 aa, Triticum aestivum
  unsure (1)..(394): unsure at all Xaa locations
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPXGTHEFLLLDEGKWQHVKDTTSIGEGKMFSPGNPRARFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 8143 - protein, 241 aa, Triticum aestivum
  unsure (1)..(241): unsure at all Xaa locations
SATFSIVKQCHALGCFPRVKIVHTSRWIHGQIYIPEINWILMVLCVAVTVAFGDTTLIGNAYGIACMTVMLVTTFLMSFIVIFVWQKNIIFALLFLLFFGSIETVYLSSSLMKVHQGGWVPLVLAFIFMSVMFVWHYGTKKKYQFDLQNKVSMRSILSLGPNLXXVRVPGIGLIYTELVTGVPAIFTHFVTNLPAFHEVLVFLCVKSVPVXPYVQPDERYLXVGRIGPXAYXRMYRCIVRV

SEQ ID NO: 8144 - protein, 419 aa, Polyopes affinis
ETDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGLDYVTEGPQLLQDAAKTC

SEQ ID NO: 8145 - protein, 51 aa, Glycine max
MASPVEKLKSLWNSQVMDEEQWAVNYRVLKAAGIFAGSIFLMRTFGDMMVV

SEQ ID NO: 8146 - protein, 85 aa, Zea mays
MCLAVPCCSYCLKLLEMFDKYGGMWHHSRVRKYLTSEDFAEAETDGRLWHGLALLLRKYPEHFVINIRKGGGLITEFVSLVSLQS

SEQ ID NO: 8147 - protein, 385 aa, Populus alba
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 8148 - protein, 573 aa, Pseudomonas syringae pv. syringae B728a
MSRRKRRLEKMTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTESMDNLLDFQKRLAQKTADVSGWTAGSEAFPQLLDVVTHAGATVMIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGKGDAVLPPLKEIQQVSRKIALAVAREAQAEGLALETTEEALLEAIERNFWLPGYRAYRRRSV

SEQ ID NO: 8149 - protein, 82 aa, Chenopodium rubrum
GFAWSWGPLGWLVPSEIFPLEIRSAAQSINVSVNMFFTFVIAQIFLTMLCHLKFGLFLFFAFFVVIMSVFVYLFLPETKGIP

SEQ ID NO: 8150 - protein, 241 aa, Chloroflexus aurantiacus
MRFLSAADIAQAVPMSAAIDAVAQAFGMLARGEADIPLRTAITTPAQAATTFFMPGRLGGETPALGIKTVSVFPHNVYRAEPTIYALVTLFDPASGRPIAVLDGTYLTALSTGAASGVATRLLAREDVRTLVVFGAGAQALPQLQAVLAVRPSINPVWIVNRTRDRATLLAARLRGEGSRGDIRIDTDPTMPLAEADVVCTATSSPNPLFAADLIRPGTHINAVGAYTPRHGRTAPRSGCP

SEQ ID NO: 8151 - protein, 183 aa, Candidatus Blochmannia floridanus
MISHTDHQLTLIKENIKFIPNYPKQGILFRDITALLENPHAYSACIKLLADHYKNHQLTKIVGVEARGFLFGSPLALILKLGFIPARKAGRLPRNTISESYVLEYGTGCLEMHNDSIIPGDRVLIVDDLLATGGTIKAVVKLIRRLGGEVYHAAFVIDLEKLGGKLLLEKIGVHPYSLVIFSD

SEQ ID NO: 8152 - protein, 224 aa, Magnetospirillum magnetotacticum
MQGPYSMKFFIDTAEVAEIRELAATGLVDGVTTNPSLIAKSGRKILDVIAEICDIVPGPISAEVAATDFDTMLAEGRKLAALRPNVAVKVPLTLAGLKTCKVLADDGVKVNVTLCFSANQAILAAKAGAAFISPFVGRLDDIGQDGMDLIADIVSIYREYPAFRTEVLAASIRHPMHVTEAARLGAHVVTMPASVLRQMVQHPLTDKGLAAFMADWAKTGQSIL

SEQ ID NO: 8153 - protein, 472 aa, Escherichia coli CFT073
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 8154 - protein, 365 aa, Pseudomonas syringae pv. syringae B728a
MPTTHLNYVTYEPLGTVLQITPWNAPIFTCGWQIAPAIAAGNAVILKPSELTPLSSLMVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQESIFEKFTNALAVAATQFKVGDPSDPETQIGPINNAKQYNHVKNMVEQALKDGAKLVGEHADPIPEKPGYYINPTVLAGTNALYCAQEEIFGPVVVAIPFKDEEDAIRIANDSRFGLAGGVWTRDVGRAHRVARQVRAGTFWVNGYKTIHVSSPFGGYGESGYGRSSGLDALREYSEVKSVWVETAAKPAASFGYGASLE

SEQ ID NO: 8155 - protein, 160 aa, Triticum aestivum
  unsure (1)..(160): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFXVKHNASPGYYDGRYWTMWKXLPXFGXTDAXTXVINXVGGKVKKGVPWTPMFRNHRSTASRC

SEQ ID NO: 8156 - protein, 133 aa, Kandelia candel
DPLDGFFSSAVANVPFNSANEAAAFANARFDWKETPEAHVFKADLPGLKKEEVKVEVEEGRILQISGERRKEQEEKNDKWHRLERSSGKFLRRFRLPENAKMYQVKASMENGVLTITVPKEEEKKPEVEAIEI

SEQ ID NO: 8157 - protein, 194 aa, Triticum aestivum
MPVSSVAKPSSAKPNPFDSDSDSEFTSRPARASSSNSVDPGTNGRCKNGFRDSGGFDNQSVQELESYVAYKAEETTQKVNVCLRLAENIKEDATNTLIALHKQGEQMNRTHETAANIDQDLSRSETLLGSLGGFFSKTWKPKKTRQIKGPAVISRDDPFKRRANHLEQREKLGLSSSPRGKSNPQTYSDPTNAM

SEQ ID NO: 8158 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 8159 - protein, 465 aa, Gracilaria tikvahiae
AKMGYWDPNYVVKDTDVLALFRVSPQPGVDPIEASAAVAGESSTATWTVVWTDLLTACDLYRAKAYKVNEVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRSIAATGEVKGHYMNVTAATMEDMYERAEFAKQLGTVIIMIDLVIGYTAIQTMAIWARRNDMILHLHRAGNSTYSRQKIHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILLDAAKTCGPLQTALDLWKDITFNYTSTDTADFVETPTANV

SEQ ID NO: 8160 - protein, 485 aa, Oryza sativa
KIKPRIEGDPFREGSGYQHPMVLVQIPMCNEKEVYEQSISAACQLDWPREKFLIQVLDDSSDESIQLLIKAEVSKWSHQGVNIVYRHRVLRTGYKAGNLKSAMSCDYVKDYEFVAIFDADFQPTPDFLKKTIPHFEGNPELGLVQARWSFVNKDENLLTRLQNINLCFHFEVEQQVNGVFLNFFGFNGTAGVWRIQALEESGGWLERTTVEDMDIAVRAHLNGWKFIFLNDVKVLCELPESYEAYRKQQHRWHSGPMHLFWLCLPDILTAKISSWKKANLILLFFLLRKLILPFYSFTLFCVILPLTMFVPEAELPVWVICYVPVCMSFLNILPSPRSFPFIVPYLLFENTMSVTKFNAMVSGLFKLGSSYEWIVTKKSGRSSESDLSTAVERDTKDLTLPRLQKQISESELIDLKMQKERQEKAPLGAKKANKIYKKELALSLLLLTAATRSLLSAQGIHFYFLLFQGVSFLFVGLDLIGEQID

SEQ ID NO: 8161 - protein, 364 aa, Buchnera aphidicola (Uroleucon obscurum)
MKTQYRIAVLPGDGIGPEVMREAYKILKILKNNFLLSFEIEEFNVGGIAIDQEGLALPKKTLLGCEKSDAILFGSVGGKKWDNFPIEERPERAALLPLRKHFNLFANLRPAKIYSELKHLSPLRSNIVRDGFDILCIRELTGGIYFGQPSGRRLEKNNIEYAFDTEIYYDYEINRIAHLAFQLAQSRSHKVCSIDKSNVLNSSILWKEIVQKVSKNYPDVDLSHLYIDNAIMQIIKNPNQFDVLLCPNLFGDIISDECAIITGSIGMLPSASLNEKKFGLYEPAGGSAPDIAGKNIANPIAQILSLSMLVRYGMNLKDIADKIDKSVLSVLKKGYRTADISNNNNYLKTNEMGDVIANALISGE

SEQ ID NO: 8162 - protein, 259 aa, Oryza sativa (japonica cultivar-group)
MVGCSWRSIGMGRGRVELKRIENKINRQVTFAKRRNGLLKKAYELSVLCDAEVALIIFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 8163 - protein, 719 aa, Zea mays
VVENDLFKQDWRSRKKKQIFQYIVLKWSLVLLIGLLTGFVGFFNNLAVENIAGFKLLLTSDLMLKGRYIRAFFVYGGCNLVLAAAAAAICAYIAPAAAGSGIPEVKAYLNGVDAYSILAPSTLFVKIFGSILGVSAGFVLGKEGPMVHTGAFIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTVAVYSTPDLIAIIVLGIIGGIFGGLFNYLLDKILRVYSIINERGAPFKILLTIPISIITSMGSYGLPWLAACTPCPVDAVGAVSHCWPLPEIIRTSKCPPGHYNGLASLFFNTNDDAIRNLFSNGTSTEFQMSSLFIFFTAIYCLGLVTYGIAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 8164 - protein, 454 aa, Porphyra kanakaensis
  unsure (1)..(454): unsure at all Xaa locations
IKETDILALFRITPQPGVDPIEASAAIAGESSTATWTVVWTDLLTACDLYRAXAYRVDPVPNVADQYFAYIAYDIDLFEEGSIANLTASIIGNVFGFKAAKAXRLXXXXMPXXXXKTXQGPATGXXVERERMDKFGRPFLGATVKPKLGLSGKNYGRVXYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 8165 - protein, 388 aa, Streptococcus pyogenes MGAS8232
MKNQLGQLALEQAKTFGGKLEVQPKVDIKNKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 8166 - protein, 369 aa, Oryza sativa
MTQVRGASRLTPSLPPNCYNNKSSSSSSSSSSSSTSRAAAAAAVRVMAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTVVTLTAGASPREGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKRYRVVDF

SEQ ID NO: 8167 - protein, 550 aa, Agrobacterium tumefaciens str. C58
MKRTGGQLIVEALKANGVSRVSCVPGESYLAVLDALYESGIETVVCRQEGGAAMMADTWGRLTGEPGICMVTRGPGATNASAGLHIARQDSIPMILFIGQVQREAREREAFQEVEYRRAFTEFAKWVGEIDDARRIPEFVTRAFAVATSGRPGPVVLTLPEDMLVEEVEAPEAKPYMPVEAHPGPSQMTAFAKMLGEAKRPIFIIGGTRWSEESVATFRAFAENHKLPVGCSFRRQMLFDHLSPSYAGDVGIGINPALAKEIKESDLVVLLGGRLSEMPSSGYTLIDIPYPSQKLIHIYPEAEELGRVYRPDLAICAAPDDFVAVLSSLTLSGSAAWAERTAAMHAAYLAWSTPPQTGPGTVQMGPIMDWIEANVADDAIFTNGAGNYATWLHRFHRFRRYNTQSAPTSGSMGYGLPAAVAAKHLFPEREVICFAGDGCFMMHGQEFITAVRYGLPIITVLVNNGTYGTIRMHQEREYPGRVSGTDLVNPDFNAFAKAYGGHGETVERTQDFAAAFERARASGKPGIIEVKLDPEAITPTRTLTQIRTKS

SEQ ID NO: 8168 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIDSGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 8169 - protein, 125 aa, Zea mays
GTGFTPRDVTRGGITNVRPGASCRGTFVMLQESLKITPFAMLSRATAGIRGSTLIINMPGNPNAVAECLEALLPALKHALKQIKGDKREKHPRHTPHAAAAPVDQWERSFRAASSGSGGGCSCDP

SEQ ID NO: 8170 - protein, 979 aa, Oryza sativa
MVGADGRAKLADFGCARRTDSERPIGGTPAFMAPEVARGEEQGPAADVWALGCTIIEMATGRVPWSDMDDVFSAVHRIGYTDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTVRARGFIEYDRQLSRIVSCSPTLEDCIVKCPIGFAATAGLPLGSPQPDYSHTCDTYSTRDVLEVFVPVPHDDRTCLWRLGAPPASNSTNAGTSALTVGQARADGAAEEAWCTLRVKDGQRRRDGSGGGWTRRCKGGLAPGPQVPMHLAGGSDADPSNGESQDKTPAKKGQKTHDHNRSYNFVPPSFADMQMQGRESVAQSRFRTCCTRSAGPYKYTSPPPHRTPHTDSIRTRQEKKKKQREKNSKDQEIEAMAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHVHLGSGKNEIFHPFDTDGTESGLDAHRLTALQKHQWNLSSRLPHSSWIDRTFGIACAYQRHVIRSTDQTYKHQQETARLFTGCDYPEQFGHATMQMRFRHMF

SEQ ID NO: 8171 - protein, 497 aa, Aspergillus niger
MSDLFATITTPNGVKYEQPLGLFIDGEFVKGAEGKTFETINPSNEKPIVAVHEATEKDVDTAVAAARKAFEGSWRQVTPSTRGRMLTKLADLFERDAEILASIEALDNGKSITMAHGDIAGAAGCLRYYGGWADKIHGQTIDTNSETLNYTRHEPIGVCGQIIPWNFPLLMWAWKIGPAIATGNTVVIKTAEQTPLSGLYAANVIKEAGIPAGVVNVISGFGRVAGSAISHHMDIDKVAFTGSTLVGRTILQAAAKSNLKKVTLELGGKSPNIVFNDADIDNAISWANFGIFYNHGQCCCAGSRILVQEGIYDKFIARLKERALQNKVGDPFAKDTFQGPQVSQLQFDRIMEYIQHGKDAGATVAVGGERHGTEGYFIQPTVFTDVTSDMKINQEEIFGPVVTVQKFKDVEDAIKIGNSTSYGLAAGIHTKDVTTAIRVSNALRAGTVWVNSYNLIQYQVPFGGFKESGIGRELGSYALENYTQIKAVHYRLGDALF

SEQ ID NO: 8172 - protein, 357 aa, Zea mays
HQEVQFHLSAFKAFLDIAGDNLSGKIFTEAFDAACFPLTLFSTLFEPGWSSGSSAVAIQGLLSLLVEGGAENVNQCFLEASRFGSTELVRILLKIAHQNSLAVDVDLALVYASHYCKFETMACLVDEGHATSFLCPLVKASERGCLQVVQWFVNRHVSDIEMCLAVTTAASCGHFAVATYLLAHIPRHVLEALSPQILKAARGQGSGSFEGVSFLLRSNFLNDAAATYAVADSIATTSTMDIPQDLVDFLKEQWSQAAFAEGVEAGEDHFVNITRVLRRGASPIRLHDLPEPMALAIAYLPLYRACASARGQLLPQRLRGELVEAVGRLGVPVNMENNRRDFLAVLEHYFPSFITGA

SEQ ID NO: 8173 - protein, 427 aa, Thorea violacea
  unsure (1)..(427): unsure at all Xaa locations
IEASAAVAGESSTATWTVVWTDLLTACDLYRAKAYKVDAVPNNSEQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSMEGVNRAQAATGEIKGHYLNVTAGTMEEMYERAEFAKELGSVICMIDLVIGYTAIQTMAVWARKADMILHLHRAGNXTYSRQKSHGMNFRVICKWMRMAGVDHIHAGTVVGKLEGDPIMIRGFYNTLLLSHLDINLPQGLFFEQNWASLRKVTPVASGGIHCGQMHQLLDYLGDDVVLQFGGGTIGHPDGIQAGATANRVALESMVLARNEGKDYVNEGPQILKDAAKTCGPLQTALDLWKDITFNYTSTDTADFV

SEQ ID NO: 8174 - protein, 233 aa, Bradyrhizobium japonicum USDA 110
MTQAFTPRPLAIAPSILASDFSRLGEEVRAVDAAGADWIHLDVMDGHFVPNISYGPDVIKAMRPHTKKVFDAHLMISPCDPYLEAFAKAGCDHITVHAEAGPHLHRSLQAIRALGKKAGVSLNPGTPIGVLEYVIDLVDLVLVMSVNPGFGGQAFIPSAIGKIRDIRAMTAGRPIDIEVDGGVGPDVAGALAAAGANAFVAGTSVFRGGTQDAYRTNIAAIRNAAAGARGEAI

SEQ ID NO: 8175 - protein, 224 aa, Oryza sativa
  unsure (1)..(224): unsure at all Xaa locations
MSRRYDSRMTIFSPEGRLYQVQYAMEAIGNAGSALCVLAADGVVLVGEKKVTSKLLQTSCSAEKMYKIDSHLACAVAGIMSDANILFNTGRLHAQRYILSYQEPIPVEQLIQSLCHTKQGYTQFGGLRPFGVSFLFGRWDKHHGFQLYMSDPXYSGWKAAAVGANSQATKSMLKQLLPLPSPRHPSPAADALLPPAKSEKGERDEEGRKEGKGKRERELADVAA

SEQ ID NO: 8176 - protein, 436 aa, Magnetospirillum magneticum
MELHHPELTYAAIVALAAVLCGGLMTRLKQPAIVGYILAGVVLGPSGFGLVSNRDAVATLGEFGVLMLLFVIGMKLDIIRFLEVWKTAVFTTLLQIAGSVGTALLLRHGLGWSLGLAVVLGCAVAVSSTAVVIKVLESSGELETPVGRTTLGILIAQDMAVVPMMLVLESFETKALLPADMARVVLSVLFLVLLFWWLSKRRIDLPVTARLSRDSDLATLSTLAWCFGTAAISGVLDLSPAYGAFLGGVVLGNSAQRDMLLKRAQPIGSVLLMVFFLSIGLLLDFKFIWKNLGTVLTLLAMVTLFKTAFNVTALRLAGQDWPSAFLAGVALAQIGAFPFLLAKTGKAVGRITAQKTKLVVGVTVLSLVLPPFWLFTMRRIHRVAAVHVHSFRDLVTRLYGDEARALVRTARRARMLARRGSWRDDPNAGPGSGIST

SEQ ID NO: 8177 - protein, 483 aa, Streptomyces violaceus
MTQGPLTTEAGAPVADNQNSETAGVGGPVLVQDQLLLEKLAHFNRERIPERVVHARGAGAYGTFTLTRDVSRWTRAAFLSEVGKRTETFLRFSTVAGSLGAADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTQDEANRLAGEDPDSHQRDLREAIERGDFPTWTVQVQIMPAADAAGYRFNPFDLTKVWPHEDYPPVEIGTLELNRNPENIFAEVEQSIFSPAHFVPGIGPSPDKMLQGRLFAYGDAHRYRVGINADHLPVNRPHATEARTHSRDGFLYDGRHKGAKNYEPNSFGGPVQTDRPLWQPTPVTGVTGDHAAPSHAEDDDFTQAGDLYRLMSEDEKGRLIDNLSGFIAKVSRDDIAERAIGNFRRADEDFGKRLEAAVQALRG

SEQ ID NO: 8178 - protein, 147 aa, Triticum aestivum
AEEDEPASALAIDALSQVKHILLPITDRYPYLSEGTREAAATTTSLAKKYGANITVVFIDEKPKESFQEHDTQMSSIRWHLSEGGFTEFGMMQRLAEGKKPTATIAVVADYLDFDLVVLSMEAIHSKQVDGNLLAEFIPCPILMLPL

SEQ ID NO: 8179 - protein, 430 aa, Oryza sativa
MAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHGLDAHRLTALQKHQWNLSSRLPHSSWIDRTFGSDLDIGVQLATTC

SEQ ID NO: 8180 - protein, 196 aa, Salmonella typhimurium LT2
MDTLRIGLVSISDRASSGVYQDKGIPALEEWLASALTTPFEVQRRLIPDEQEIIEQTLCELVDEMSCHLVLTTGGTGPARRDVTPDATLAIADREMPGFGEQMRQISLRFVPTAILSRQVGVIRKQALILNLPGQPKSIKETLEGVKADDGSVSVPGIFASVPYCIQLLDGPYVETAPEVVAAFRPKSARRENMSD

SEQ ID NO: 8181 - protein, 437 aa, Oryza sativa
  unsure (1)..(437): unsure at all Xaa locations
VLFISNHMRRAAPAVITSVRARQILDGRGEPAVEVSLHTNKAVHRASAAAADAPEGAAADAVRDAEKRKPVARAVGDXSLVGTDPRRRPLFDRASMDLDRAHRQAGIGTNSMLAVRFAXIQACAYQMQLLLQVHMKKRFGKSATSLPIPAITVINGATHAGNSLPIQEIMILPVGAKNFEEAMQMGSETYHHLKDIILEKYGSNSCNIGDDGGFAPNISSITEGLDLVIEAINRAGYNGRIKLAIDVAATDFCMGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 8182 - protein, 339 aa, Corynebacterium efficiens YS-314
MIITEGVDSFVFPHRSGPRVGLCRIFHVFGAVGFDFFDTVQGVAPRCVEHEGPRGIFPILAPMKTIVITGASDGIGAAAARIISTACPEDRLVLVGRNPGKTEGVAKQLDAEWHTADYADLDQVRRLAGELAALDRIDVLANNAGGIFAGPKKTVDGFELTWQINVVAPYLLTNLLMPVLLESRASVVATSSNGALFAKFDESDPNTFKGFTSDRAYGNAKLGNILFTKELHRRYHSAGMNAVAFHPGIISSNFGQEDAGLLGRMFQSPVSRFFSTPEFGGENLAYHIAGVPGIHWESGRYYDEKRRPGRQRAIAHDLDVARRVFDDMAASLEVEWPEG

SEQ ID NO: 8183 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 8184 - protein, 183 aa, Methanosarcina mazei Goe1
MSESSIKIENVVASTKLAEEFDLTVIESQFEGAEYNKQKFPGLVYRVSDPKAAFLVFTSGKVVCTGAKNVADVHTVIGNMAKKLNSIGIKTMENPQITVQNIVASADLHTILNLNAIAIGLGLENIEYEPEQFPGLVYRIDEPKVVVLIFSSGKLVVTGGKTPEDCESGVEVVRQQLDNMGLL

SEQ ID NO: 8185 - protein, 143 aa, Zea mays
DHWTDDKNNKYGFAVMYGLTSFFANFGPNTTTFIIPAEIFPARLRSTCHGISGAFGKLGAIIGVFAFVYAEKHNNNRSMLFALVGCNLVGLVFTLLLPESKGKALEEISGEMEEQHPEQDAAAVAASGVCKCGACLVVKMCTV

SEQ ID NO: 8186 - protein, 484 aa, Comamonas testosteroni
MKDIQNFINGAYVSTGRSFDKHSPLTGKVIAKVHEAGRNEVDAAVTAARTALNGPWGRMSVAERVEKLYAVADGINRRFEEFLAAECADTGKPRSVASHIDIPRGAANFKIFADVVKNVPTEFFEMATPDGRGAINYGHRGPVGVVGVICPWNLPLLLMTWKVGPALACGNTVVVKPSEESPQTAALLGEVMNEAGIPPGVYNVVHGFGPDSAGEFVTSHPGVDAITFTGETRTGEAIMKAAAKGARPVSLEMGGKNAAIVFADCDFDAAIDGTLRSAFVNSGQVCLGTERVYVERPIYERFVAALKQQIEGWKIGVPEDDDTKLGPLISKEHQAKVLSYYQLAVQEGATVVTGGGMPDLGAQYADGAWVQPTIWTGLPETARVIKEEIFGPCCHIAPFDTEEEVLTKANDNVYGLASAIWTQDLARAHRVAQRMHVGISWVNSWFLRDLRTPFGGAKQSGIGREGGVHSLEFYTELKNVCIKL

SEQ ID NO: 8187 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEQSALEGMLDTL

SEQ ID NO: 8188 - protein, 409 aa, ASPERGILLUS NIDULANS FGSC A4
MVQIKDFAVEQWMDKYETTAKYNVAETCSASISVRDLQALCEDPALNPLDGVLDRKLTYGEIRGSKQLRSTLANLYSVRTPTPLPSDNILVTAGAIQANFLLLYTLVGPGDHVICHYPTYQQLYSVPESLGAEVSLWKSKEAEGWKLDLEELKGLIRPNTKLIIINNPQNPTGAIIPQGTLDEIVEIARSSSIYVFCDEVYRPLFHSISPMDPDFPSSVLSLGYERAIVTGSLSKAYSLAGIRVGWIASRDRTVIEACASSRDYTTISVSQLDDAVASYALAPTTIHALLKRNIELGRTNLGILEKFIESHRWACDWVKPRAGTTAFVRFNKMGKPVNDTAFCEMLLERTGVMLVPGSLCFGGGEDFLGYVRIGYVCETQVLEEGLAKLKAFLEDDYEEVPAVKRKTQS

SEQ ID NO: 8189 - protein, 246 aa, Zea mays
MAGLSLPHPMAFAFGLLGNIISFMTYLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSLSLTVSAVVWFLYGLLIKDKYVALPNVIGFSFGVVQMGLYALYRNATPRVPFKDVADDGKDQAPGEHVGTIAKLT

SEQ ID NO: 8190 - protein, 188 aa, Schizosaccharomyces pombe
MSDDRINYLKNKLVQYPDFPKKGILFEDIMPIFQDPRAFGILIDLLLEAVETEFNNIDVIVGLEARGFLFGPTLALRANCAFVPVRKPNKLPGDLVVVSYNKEYSTDSFAIQKGTIKPGQRVLIVDDILATGGTALAADELVTRLGGELVGHLFLLELTFLQGRKRLMAPTYTLLTGQDEAPDGSEFA

SEQ ID NO: 8191 - protein, 176 aa, Glycine max
  unsure (1)..(176): unsure at all Xaa locations
TILPIIYIMWIRSHEFHDVSIGIRMITRPLRRCXYLYMYWQLSLGSLVLDMRVQEHTRVCHRILLTYGVDLVLNDVNTLLSYTQSEIIILEIRSEFXHYDPPEFYMYLXEQLGEHLIHHDDAVFGNTVAELLSKRVICVWKPQKSFQPKPWSPLWSAGLSEDYWINTDLTSTKFDG

SEQ ID NO: 8192 - protein, 374 aa, Chloroflexus aurantiacus
MRHTSRITLSGGSMDAYKPVVHGALDEAELARLGLRADHLIDFSSNINPFGPPESVLQALRTLNPAPYPDRSCLHLRRHLAAIHHCQPEAVLVGNGANELIHLVARALGEPGATALVVAPTYGEYAYASHLAGMRVIEIRSTVGNGFQPDLAELLLTIERLRPRLIWLCSPNNPTGVNLSVTTITELAHTCALHQGWLILDRAYLALGRDETGHDPLDHNSPSRLIRIYSLTKSYAVAGLRIGYMIADPDVIAATARFQPAWSVSSAAQAAAAAMLHDTGFLATTLPALWDASSELAQNLRQIGLTVWRAHLPFMLVHCDNAALTRQQLLVRGCVVRDCTSFGLPEWVRVAPRRPSENARLLAAWRDVHARTQV

SEQ ID NO: 8193 - protein, 156 aa, Glycine max
  unsure (1)..(156): unsure at all Xaa locations
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 8194 - protein, 192 aa, Corynebacterium efficiens
MDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 8195 - protein, 320 aa, Streptococcus gordonii
KVGINGFGRIGRLAFRRIQNVEGVEVTRINDLTDPVMLAHLLKYDTTQGRFDGTVEVKEGGFEVNGKFVKVSAERDPENIDWANDGVEIVLEATGFFATKAAAEKHLHAGGAKKVVITAPGGSDVKTVVFNTNHDVLDGTETVISGASCTTNCLAPMAKALQDNFGVVEGLMTTIHAYTGDQMVLDGPHRKGDLRRARAAAANIVPNSTGAAKAIGLVIPELNGKLDGAAQRVPVPTGSVTELVAVLDKNVTVDEVNAAMKAASNESYGYTEDPIVSSDIVGMAYGSLFDATQTKVLDVDGKQLVKVVSWYDNEMSYTAQ

SEQ ID NO: 8196 - protein, 179 aa, Glycine max
  unsure (1)..(179): unsure at all Xaa locations
FGTRIATTDLAQHTLEQIEPIRNLFAALFLASIGMLIHVHFLWXNHVDILVASVILVIVIKTIIIASVVKGFGYNNKTSIHVGMSMAQIGEFAFVLLSRASNLHLVEGKLYLLLLGTTALSLVTTPLLFKLIPAVVHLGVLLRWFSPDSSVEIGYKLDNLRSDSGKQRIIXMDQESHDS

SEQ ID NO: 8197 - protein, 465 aa, Bacillus subtilis subsp. subtilis str. 168
MKGSVFRKKSIQDLIAATSGEKSLKRELGAFDLTLLGIGAIIGTGIFVLTGTGAVTAGPGLTISFVVAALACLFAALSYAEFASSVPVSGSVYTFTYATLGELMAFIIGWDLILEYMLAVSAVSVGWSGYFQSFLSGLGIHLPVALTAAPGAVKGTFTLFNLPAFVIVMAITYLLYLGIKESKRVNNIMVILKILVVLLFIAVAAVYVKPHNWQPFMPMGFGGVFSAAALVFFAFIGFDAVSSAAEETKNPAKDLPKGIIFSLLVCTILYVTVSAIMTGVIPFAQFAGVDHPVSLVLQSAGQNWVAGIIDIGAVLGMTTVMLVMLYGQTRVMFAMSRDGLVPGSLSKVHPKHKTPYVATWFFGTMSALLGSLVPLDELAKLVNIGTLSAFVLISVAVIVLRKKQPDLPRAFKCPGVPVIPGLAILFCLFLILNLGWVTIVRFLVWLLIGLVIYFLYSRKHSKLNQ

SEQ ID NO: 8198 - protein, 540 aa, Glycine max
MQVMASRILSTLHYVCSSSASATKRCLGLYSHWQRSISGIAASVVADVEPSIAPVQIDQSQLLIDGKFVDAASGKTFPTFDPRTGDVIANVAEGDAEDVNRAVHAARKAFDEGPWPKMTAYERSRIILRFADLLEKHNDEVAAIETWDSGKTYEQAANVEIPMVVRLFRYYAGWADKIHGLTVPADGPYHVQTLHEPIGVAGQIVPWNFPLLIFSWKVAPALACGNTVVMKTAEQTPLSALYVSKLFLEAGLPPGVLNVISGFGPTAGAALCSHMDVDKLAFTGSTSTGKRVLELSAHSNLKPVTLELGGKSPFIVCKDADVDAAVEASHFALFFNQGQCCCAGSRTFVHESIYGEFVEKAKARALKRVVGDPFKNGVEQGPQIDSVQFEKIMKYIRSGVESGAQLESGGQRIGSKGYYIQPTVFSNVQDNMLIAKDEIFGPVQSILKFKDLEEVIRRANATSYGLAAGVFTKNMDTANTLMRALQAGTVWINCYDVFDAAIPFGGYKMSGQGRVRGIYSLRSYLQVKAVVTALKNPAWL

SEQ ID NO: 8199 - protein, 260 aa, Hordeum vulgare subsp. vulgare
AGGHAADRIVRLPGQPEVDFDMYSGYITVDEAAGRSLFYLLQEAPEEAQPAPLVLWLNGGPGCSSVAYGASEELGAFRVMPRGAGLVLNEYRWNKVANVLFLDSPAGVGFSYTNTSSDIYTSGDNRTAHDSYAFLAAWFERFPHYKRREFYVAGESYAGHYVPELSQLVHRSGNPVINLKGFMVGNGLIDDYHDYVGTFEFWWNHGIVSDDTYRRLKDACLHDSFIHPSPACDAATDVATAEQGNIDMYSLYTPVCNISS

SEQ ID NO: 8200 - protein, 312 aa, Shigella flexneri 2a str. 2457T
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKNCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGKEFVNK

SEQ ID NO: 8201 - protein, 394 aa, Zea mays subsp. mays
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKXTVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 8202 - protein, 234 aa, Deinococcus radiodurans
MEFFIDTAIVDEIREINAWGVLSGVTTNPSLIVASGRDFKEVIGEIAELVPGGAISAEVTALDAEGMIKEGKDVAAWHKQVVVKLPLTPAGLQACKALTSEGIKTNVTLCFSVPQALLAARAGATYVSPFVGRVDDTGWDGSELIRQIKEAFVLGDIQTKVLAASIRHPQHVVQAALAGADVATIPYKVFTQMVKHPLTQAGLDSFMADWAKRQGASPETPPSEAGTNPVKKEG

SEQ ID NO: 8203 - protein, 223 aa, Mycobacterium tuberculosis CDC1551
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYREYGAATLEILAEGIEVAGRRVVIIDDVLATGGTIGATRRLLERGGANVAGAAVVVELAGLSGRAALAPLPVHSLSRL

SEQ ID NO: 8204 - protein, 392 aa, Oryza sativa
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 8205 - protein, 316 aa, Colletotrichum gloeosporioides f. sp. malvae
MPAPFSARPCLAPFPPKQLFGVSQVLLQIRHPGCRGPGRLWTGLIRTHRISPGPATRILMASMSSAIRIHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYIRNLPFMPKKPFPQLFAQANPDALDLLDRMLAFDPSSRFSVEQALEHPYLHIWHNASDEPDCPTTFNFDFEVVEDVGDMRKMILEEVYRFRQLVRPSRQHPTGAQAAGQAGAGQVPFLWKPRLDSSDPD

SEQ ID NO: 8206 - protein, 244 aa, Lycopersicon esculentum
MGRGKVELRKIENKINRQVTFSKRRGGLVKKAHEISVLCDAEVALIVFSQKGKIFEYSSDSCMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 8207 - protein, 287 aa, Arabidopsis thaliana
MERIQKDVTQSMRGIRVTEQQEHGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTTTFLRRFIQPAQASYKVPFIELEYLANYLAELTLVEYSFLRFLPSLIAASAVFLARWTLDQTDHPWNPTLQHYTRYEVAELKNTVLAMEDLQLKHQWLYSRCHP

SEQ ID NO: 8208 - protein, 285 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 8209 - protein, 509 aa, Zea mays
MAYPAAPHTSAAFLASFATPLPARCASPPTRRRAVSAAAIATTTTCVFADAPRGIKEEQADSGAQAAAAAAARRDVSPDTVASIILGGGAGTRLFPLTRTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDFGLMKADRNGHITDFLEKPKGADLESMQVDMGLFGLSPEFASTYKYMASMGIYVFKADVLRKLLRGHYPTANDFGLEVIPMAAKDYDVQAYLFDGYWEDIGTIKSFFEANLALTDQSPNFYFYDPVKPIFTSPRFLPPTKVLNSIVSHGCFLTECSVEHSVIGIRSRLEPGVQLKDTMMMGADYYQTEAERLSELSVGKVPVGVGENTKIRNCIIDKNARIGKNVVIMNSENVQEADRPAEGYYIRSGITVVLKNAVILNGTKI

SEQ ID NO: 8210 - protein, 376 aa, Oryza sativa (japonica cultivar-group)
MATGGEPRAAAAAEGGEKRAALLREITEEGGFAFVASAEKAAADGDLRAAEAAREMAWEQLHACPRSEVGRAWRDAYALACLHVAALRVAGGGGDGRRAALRALDMGLIMGGDLLRAELEEAIARVVADRSRGCGGGGGDGAGENGADVEKWMEGLTRKRDLADVLKVLPVKSLSCKQIERRSCISLEAFIRDYFLCESPVILSGYIDHWPARTKWKDIRYLERIAGDRTVPVEIKELREDIMVPEYCNAGGGELQKLNAWFGPEGTVTPLHHDLYHNLFAQVLGRKYFRLYSASISNDLYPHRETMLSNISQVDLDNINVNEFPRTGDVEFMDGILEEGDLLYIPPKWWHYVRSLSTSFSVSFWWRTSIPPPQGS

SEQ ID NO: 8211 - protein, 246 aa, Pseudotsuga menziesii
YTYILRNIGPEGVLLRVIYCGICHSDLVQMRNEMGMSNYPMVPGHEVVGIVTEIGSEVKKFKVGEHVGVGCIVGSCRSCGNCNQSMEQYCSKRIWTYNDVNHDGTTTQGGFASTMVVDQMFVVRIPENLPLEQAAPLLCAGVTVFSPMKHFGMTEPGKKCGILGLGGVGHMGVKIAKAFGLHVTVISSSDKKKEEALEVLHADAYLVSRDAEKMMEAAESLDYILDTIPVSHPLEPYLALLKTNGK

SEQ ID NO: 8212 - protein, 191 aa, Yersinia pestis CO92
MLLLIDNYDSFTYNLYQYFCELGTEVMVKRNDELQLTDIEQLAPSHVVISPGPCTPNEAGISLAVIRHFADKLPILGVCLGHQALGQAFGARVVRARQVMHGKTSAICHSGQGVFRGLNQPLTVTRYHSLVIATDSLPGRFELTAWTERGGEMDEIMGIRHRTLPLEGVQFHPESILSEQGHQLLDNFLKN

SEQ ID NO: 8213 - protein, 517 aa, Arabidopsis thaliana
MAGGAFVSEGGGGGNSYEGGVTVFVIMTCIVAAMGGLLFGYDLGISGGVTSMEEFLSKFFPEVDKQMHEARRETAYCKFDNQLLQLFTSSLYLAALASSFVASAVTRKYGRKISMFVGGVAFLIGSLFNAFATNVAMLIVGRLLLGVGVGFANQSTPVYLSEMAPAKIRGALNIGFQMAITIGILIANLINYGTSQMAKNGWRVSLGLAAVPAVIMVIGSFVLPDTPNSMLERGKYEQAREMLQKIRGADNVDEEFQDLCDACEAAKKVDNPWKNIFQQAKYRPALVFCSAIPFFQQITGINVIMFYAPVLFKTLGFADDASLISAVITGAVNVVSTLVSIYAVDRYGRRILFLEGGIQMIVSQIVVGTLIGMKFGTTGSGTLTPATADWILAFICLYVAGFAWSWGPLGWLVPSEICPLEIRPAGQAINVSVNMFFTFLIGQFFLTMLCHMKFGLFYFFGGMVAVMTVFIYFLLPETKGVPIEEMGRVWKQHPFWKRYMPDDAVIGGGEENYVKEV

SEQ ID NO: 8214 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIIDPNLVAKIRPESLRKFGDTAVKCLALSSEDRPSMGDVLWKLEYALRLQESVI

SEQ ID NO: 8215 - protein, 408 aa, Glycine max
LLLSLSVAIFTSACQYGGRFLAKCTPCDPSLSDVCPTNGRSGNFKQFNCPKGYYNDLATLLLTTNDDAVRNIFSTNTPLEYQPSSIVIFFALYCILGLITFGIAVPSGLFLPIILMGSGYGRLLGILMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPAVVSFKGVEKVANIVNALKNTTHNGFPVMDCGLVPTTGVANEATELHGIILRAHLIQVLKKKWFLKERRRTEEWEVREKFTWVELAEREGNIEDVAVTKEEMEMFVDLHPLTNTTPFTVLESMSVAKAMVLFRQVGLRHMLVVPKYQASGVSPVIGILTRQDLLAYNILTVFPHLAKSKRK

SEQ ID NO: 8216 - protein, 222 aa, Glycine max
  unsure (1)..(222): unsure at all Xaa locations
MPSRQLPTSAPPPNHRVSTPLFAFTASVCSLFFLLLLCLRKRKRTTPSSNPPHPFSYPVLRRATNSFSTRLGHGGFGPVFSGTLAGDPVAVKLMDSASLQGEREFHNELLFASRLRSPLVVPAIGFSSDPKRRRFLLVYHLMHNGNLHDALLRRKTPHLTLWKNRFSIILDVAKGIHYLHSLEPPIIHGDIKPSNILLDNSFSXKLADSGLARLKSEIERFK

SEQ ID NO: 8217 - protein, 509 aa, Bifidobacterium longum DJO10A
MTEINDKAQLDIAAADDTDAVTSDTPEETVNTPEVDETFELSAAKMREHGMSETAINQFHHLYDVWRHEEASSWIREDDIEPLGHVPSFHDVYETINHDKAVDAFAKTAFLKLNGGLGTSMGLDKAKSLLPVRRHKAKQMRFIDIIIGQVLTARTRLNVELPLTFMNSFHTSADTMKALKHHRKFSQHDVPMEIIQHQEPKLVAATGEPVSYPMNPELEWCPPGHGDLFSTIWESGLLDVLEERGFKYLFISNSDNLGARPSRTLAQHFENTGAPFMAEVAIRTKADRKGGHIVRDKATGRLILREMSQVHPDDKEAAQDIAKHPYFNTNSIWIRIDALKDKLAECDGVLPLPVIRNKKTVNPTDPNSEQVIQLETAMGAAIGLFNGSICVQVDRMRFLPVKTTNDLFIMRSDRFHLTDTYEMEDGNYIFPNVELDPRYYKNIRDFDERFPYAVPSLAAANSVSIQGDWTFGRDVMMFADAKLEDKGEPSYVPNGEYVGPQGIEPDDWV

SEQ ID NO: 8218 - protein, 65 aa, Glycine max
  unsure (1)..(65): unsure at all Xaa locations
YVGPRSPTEGRVQLLEXAXVXDAHVXEFKSXEKFKIFNTNNLWVNLKAIKRLXEADALKMEIIPN

SEQ ID NO: 8219 - protein, 326 aa, Oryza sativa
MASAAVPEWLNKGDNAWQMLSATLVALQGFPGLALFYVGAVPRKWALTSAFMALYAMAATMPCWALWAHNMAFGRRLLPFVGRPAPALAQDYMLSQALLPSTLHLRSNGEVETAAVAPLYPSASMVFFQWAFAGVTVGLVAGAVLGRMSVKAWMAFVPLWTTLSYTVGAYSIWGGGFLFHWGVMDYSGGYVVLLAAGVSGYTAAYWVGPRRKEEDEEEMATASGGNLVVMVAGAGILWMGWTGFNGGDPFSANTDSSVAVLNTHICATTSIVAWVCCDVAVRGRPSVVGAVQGMITGLVCITPRSNIKYSFLLVVISDEMPVPDLS

SEQ ID NO: 8220 - protein, 176 aa, Zea mays
  unsure (1)..(176): unsure at all Xaa locations
MHASGAISYRKEKNKKDTAVAPFQGLKSTASLPIARRSSRSLGNVSNGGRIRCMQVWPAYGNKKFETLSYLPPLSTDDLLKQVDYLLRNGWIPCLEFSKVGFVYXENSTSPCYYDXPYWAMWKLPMFGCNDATQVYKELQEAIKSYPDAFHRVIGFDNIKQTQCVSFIAYKPPGSD

SEQ ID NO: 8221 - protein, 754 aa, Clostridium thermocellum
MAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFPEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIIMALENKKENAQYEQDAHHRLARQAAAESMVLLKNEDDVLPLKKSGTIALIGAFVKKPRYQGSGSSHITPTRLDDIYEEIKKAGADKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGRWRMCYSVKSIVGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 8222 - protein, 180 aa, Saccharomyces cerevisiae
MGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 8223 - protein, 304 aa, Schizosaccharomyces pombe
LLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 8224 - protein, 357 aa, Xanthomonas axonopodis pv. citri str. 306
MSKQILILPGDGIGPEIMAEAVKVLKRIDAQHGLGFQLVYDELGGTAYDKYGSPLADETLERARGADAVLLGAVGGPQWDTIDPALRPERGLLKIRSQLGLFANLRPALLYPQLADASTLKPEVVAGLDLLILRELTGGIYFGQPRGNRTLDNGERQAYDTLPYSESEIRRIAKAGFDMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFARATAADAIEHAVGKVLDQGLRTADIWSEGTTKVGTVAMGDAVVAAL

SEQ ID NO: 8225 - protein, 377 aa, Zea mays
METPLSTRRITRSLAAASAQKSAAAGMDSAALFSLSKNAVAGETHAQTRAALHDITNDSPVVGLAAGSLHATDTTPAKTRRRAPRCTPGSGEALLRGQVKALLHKVDEEQGCAAAGALVRPKRIQALLGVSRSPAQLLAPTPANTPQIGPVSAPREGVGLHDGATVVPCVLDEEELLIPKLQVIAGSLPPPQPEEKLGECQLNRALVFDDSPDNSDESSGSAVPSSVSLQEGSAGKTSSPEEGDSSSAWSTQVHASSEKGDQEELDVEELAADYTEEEEEFEEEDDWEEDSDDGCYDDLCDEMSRMTVLDEGEKKTGLPQFEGKHTRFIYNSDDEIEREEVADAAEARAELGALMLRGLPVPEGRHLRFHDDEDDEE

SEQ ID NO: 8226 - protein, 633 aa, Lycopersicon esculentum
TIGKVVSTEGRAMYNVGQAGLTYWSPNVNIYRDPRWGRGQETAGEDPTLSSRYGVAYVKGLQQRDDGKKDMLKVASCCKHYTAYDVDDWKGIQRYNFNAKVTQQDLDDTFNPPFKSCVLDGNVASVMCSYNQVDGKPTCGDYDLLAGVIRGQWKLNGYIVTDCDSLNEMYWAQHYTKTPEETAALSLNAGLGLNCGSWLGKYTQGAVNQGLVNESVIDRAVTNNFATLMRLGFFDGNPKNQLYGNLGPKDICTEDHQELAREAARQGIVLLKNTAGSLPLSPKSIKSLAVIGPNANLAYTMVGSYEGSPCKYTTPLDGLGASVSTVYQQGCDIACATAQVDNAKKVAAAADAVVLVMGSDQTIERESKDRFNITLPGQQSLLVTEVASVSKGPVILVIMSGGGMDVKFAVDNPKVTSILWVGFPGEAGGAALADVVFGYHNPGGRLPMTWYPQSYVDKVDMTNMNMRADPKTGFPGRSYRFYKGPTVFNFGDGLSYTQYKHHLVKAPKFVSIPLEEGHACRSTKCKSIDAVNEQGCNNLGLDIHLKVQNVGKMRGSHTVLLFTSPPSVHNAPQKHLLDFQKIHLTPQSEGVVKFNLDVCKHLSVVDEVGNRKVALGLHVLHIGDLKHSLTLRI

SEQ ID NO: 8227 - protein, 414 aa, Halopithys incurva
EASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAGTGEIKGHYMNVTSATMEEMYERAEFAKQSGTIIIMIDLVIGYTAIQTMAIWSRKNDMILHLHRAGNSTYSRQKIHGMNFRVICKWMRMAGVDHIHAGTVVGKLEGDPLMIRGFYNTLLLPFLEINLPQGIFFKQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDIT

SEQ ID NO: 8228 - protein, 481 aa, Helicobacter pylori 26695
MIVRTQNSESKIKEFFEFCKENEVEFVDFRFSDIKGTWNHIAYSFGALTHGMLKEGIPFDASCFKGWQGIEHSDMILTPDLVRYFIDPFSADVSVVVFCDVYDVYKNQPYEKCPRSIAKKALQHLKDSGLGDVAYFGAENEFFIFDSIKIKDASNSQYYEVDSEEGEWNRDRSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQVFSEEFIQAYQSLKFNAEVFPWESKPHPFEFITTYSC

SEQ ID NO: 8229 - protein, 332 aa, Bacillus anthracis str. A2012
MLKTTESKENEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESELVDMEKAVDEAVQKSIEFSENSPYPEDEELLKDVYVSYK

SEQ ID NO: 8230 - protein, 193 aa, Chloroflexus aurantiacus
MIIMRVLLIDNYDSFTYNLYQYLCELGADVEVVRNDQITVADVASRAPDRIVISPGPCTPAEAGISVDVIRQLGGHIPILGVCLGHQAIGAAYGGAVVRAPLVMHGKLSPIYHQGQGVFAGLPSPFRATRYHSLIVRREDLPAELEVTAWTDDGIIMGLRHRTLPVEGVQFHPESIMTEGGKQMLANFLNHGR

SEQ ID NO: 8231 - protein, 245 aa, Eucalyptus grandis
  unsure (1)..(245): unsure at all Xaa locations
MGRGKVELKRIENKINRQVTFAKRRNGLLKKAYELSVLCDAEVALIIFSNRGKLYEFCSSSSMMKTIEKYQKCSYGSLETNCSINEMQNSYQDYLKLKARVEVLQRSQRNPPWEELGPLNSKELEQLEHQLENSLKQIRSAKTQFMFDQLXHLQHKEQMLVEANRELWKKLEESNTRIPLRLGWEAEDHNNISYSRLPTQSQGLIFQPLGGNPTLQIGYNPAGSNELNVSAADQHPNGFIPGWML

SEQ ID NO: 8232 - protein, 542 aa, Zea mays
NSGGKCDFDLAATFFCSVVYLVVGGDMQFALALDTNSGPHQIRSCEGDGIDRLEKLSIGGRKQEKALRNRCFGGRVAATQQCILTSDCAPETLHSQTQSSRKNYADNARVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGYYIRSGIVVILKNATINECLVI

SEQ ID NO: 8233 - protein, 338 aa, Zea mays
  unsure (1)..(338): unsure at all Xaa locations
MGKIKIGINGFGXRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 8234 - protein, 343 aa, Chrysosplenium americanum
MLFAMQLASASVLPMVLKSAIELDLLEIIASQDTCMSPTEIASHLPTTNPHAPTMIDRILRLLSSYSIVTCSVRSVDDQRVYSPAPVCKYLTKNQDGVSIAALCVAAQDKVLMECWYHMKDAVLDGGIPFNKAYGMPIFDYFAKDLGSNKVFNKGMSDFSSMIIKKILETYKGFQGLTSLVDVGGGTGATLTKILSKYPTIRGINFDLPHVIQDAPEYPGIEHVGGDMFVSVPKGDAIFMKWICHDWNEEQCLKLLKNCYDALPNNGKVIVAEYILPVVPDSSLASKLSVTADVMIVTQNSGGKERTEKEFEALAKAAGFQGFQVFCNAFTIYIIEFSKNISN

SEQ ID NO: 8235 - protein, 287 aa, Glycine max
MANKFHVRSISFPNGSHPSTIAVEEELSNLKTWEATSTSTSKSIGVGLSLLQDLHTCLEDLLNMGSTQKLISNHQGDKCVEEVLDGSVRILDICGITRDTMLQIKENVQALHSSLRRRKGDSCVEASVAECKLFTKTMKKNAIYLISSLKQMDGKFGVSPLLDLDHHFAAVIRVLREVILINLSAFQFIVSFLTVSSSHSLTSRWSLVAQLMHTAAHPCDGTYDEMQCVEAALSSLLNEGTNDDKIHVAHERLEALEDAIESFENGLESLFRHLIKTRASLLNIISQ

SEQ ID NO: 8236 - protein, 313 aa, Triticum aestivum
  unsure (1)..(313): unsure at all Xaa locations
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGXAEVYQALKGLAKKRYGQSAGNVGDEGXVLPPDIQTAEEALELITDAIEQAGYTGQMKIAMDVASSEFYKESEKKYDLDFKNPESDPPKWITYEELANMYSELCKKVPIVSIEDPFAEDNWEAWSYF

SEQ ID NO: 8237 - protein, 784 aa, Zea mays
  unsure (1)..(784): unsure at all Xaa locations
MDAEAGVAGADQLPRRQYYLNLLLLAYQSFGVVYGDLSTSPLYVYKSTFSGKLRHYQDEETVFGVLSLIFWTFTLIPLLKYVTIVLSADDNGEGGPFALYSLLCRHAKLSLLPNQQAADEELSSYYRNGFAPRNGSSPWLRRFLEKHKKMRTLFLLIVLCGASMVIGDGVLTPAISVLSSMSGLHVRATGLHHSSVVLLSCIVLVGLFALQHRGTQKGCIXMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVSMRSILSLGPSLGIVRVPGVGLIYTXELVTGVPSIFSHFVTNLPAFHEVLVFLCVKSVPVPYVSPDERYLVGRIGPKEYRMYRCIVRYGYKDVQRDDDNFENMLVMSIAKFIMMEAEDASSASYDIANEGRMAVITTTDASGSPLAMRDFDGLADSMSTRSSKSESLRSLQSSYEQESPSVNRRRRVRFEVPEEDGMGQQVKEELTALVEAKHAGIAYIMGHSYIKARRNSNFLKKFAIDVGYSFLRKNCRGPSVTLHIPHISLIEVGMIYYV

SEQ ID NO: 8238 - protein, 200 aa, Pseudomonas aeruginosa PAO1
MRITLLDNFDSFTYNLVEQFCLLGAEVRVMRNDTPLPTIQAALLADGCELLVLSPGPGRPEDAGCMLELLAWARGRLPVLGVCLGHQALALAAGGAVGEARKPLHGKSTSLRFDQRHPLFDGIADLRVARYHSLVVSRLPEGFDCLADADGEIMAMADPRNRQLGLQFHPESILTTHGQRLLENALLWCGALAVRERLRA

SEQ ID NO: 8239 - protein, 506 aa, Pseudomonas aeruginosa PAO1
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 8240 - protein, 181 aa, Saccharomyces cerevisiae
MSISESYAKEIKTAFRQFTDFPIEGEQFEDFLPIIGNPTLFQKLVHTFKTHLEEKFAKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 8241 - protein, 328 aa, GIBBERELLA ZEAE PH-1
MVKHASKATVHQLAKEYSSIIKGKTILTTGVSPGGLGALFVEAIAVAEPELAILAGRNINKLQQTADHLASKHPNLKTKLLTLDLSSLASIRSAAQQVNGWSDVHKIDVLVNNAGIMATDFKLTEDGFENQFASNHLGHFLFTNLIIDKILAAEAPRIVSVSSNGHRLGPIRWGDANFSNGDLYNRWNAYGQSKTANMLFAISLAEKLGSRGLQAYSLHPGAILETSLGDHLANLDSLVEADRAIGDPWGWVDWSTVPVTAEVGAATHVFAAFDPDLKDHNGAYLLDCRLADPFTDTVRPWATSSTEAELLWRLSEKMVGQKFPLKLQ

SEQ ID NO: 8242 - protein, 404 aa, Nostoc sp. PCC 7120
MQFSQRLHPLQSNVFADMDKAKSLALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFADIPTDVLAQSRMMVLSYPHNPTAAIAPLSFFKEAVAFCQEHNIALVHDFPYVDMVFENAGNLNTNLPQSPIPNHQSLVPSILQADPDKSVSIEFFTLSKSYNMGGFRIGYAIGNAQMIQALRQIKAAVDFNQYRGILNGAIAALTGPQAGVEAAVSTFCQRRDAFINALHHIGWYVPTPKATMYIWAKLPSSWSQNSIEFCTQLVRQTGVAASPGAGFGKSGEGYVRFALVHEPSILKIAVERMSNFL

SEQ ID NO: 8243 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVXRRMIGTDAFQETPIVEVTRSITKHNYLVMDVDDIPRIVQEAFFLATSGRPGPVLVDVPKDIQQQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYSVEHSDLLLAFGVRFDDRVTGKLEAFASRAKIVHIDIDSAEIGKNKTPHVSVCGDVKLALQGMNEILENRAEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 8244 - protein, 404 aa, Brucella suis 1330
MPLLPVDEALAYILNSAAPHGTEDVSLTDAGGRVTASDITAQLLQPPFDCSAMDGYALIAPEEITYPLELTVIGESAAGKRFEGTLRKGEAIRIFTGAPMPENADSIIIQEHTEREGNRLIILHGLDKGRHIRRAGLDFAPGKVVVPAGRELDAPALSLAAASGHARLPVFTRPRVAILATGDELVPPGAIPGPDQIVASNSIGIAEITRRAGGTPEDLGIIADDPARIEKAISDALEDGIDMLVTIGGASVGDRDFVHGALRNCGVALDFWKIAMRPGKPLMYGRKAVNGKTVHVLGLPGNPVSSLVCSLLFLRPLVAKLSGLALKADIRAAKLGVAMRANDHRRDFIRVTVESEPDGTLVAAPFPMQDSSMLSALVCSDALLIREENAPEALPGDPCRILML

SEQ ID NO: 8245 - protein, 441 aa, Tichocarpus crinitus
  unsure (1)..(441): unsure at all Xaa locations
PQPGVDPVEASAAVAGESSTATWTVVWTDLLTACDLYRAKAYKVDAVPNTSDQYFAFIAYDIDLFEEGSIANLTASIIGNVFGFKALKALRLEDMRLPVAYLKTFQGPATGIIVERERMDKFGRPFLGATVKPKLGLSGKNYGRVVYEGIRGGLDFLKDDENINSQPFMRWKERYLYSMEGVNRAVAASGEVKGHYLNVTAGTMEDMYERAEFAKQLGSIIVMIDLVIGYSAIQSMAIWSRKNDMILHLHRAGNSTYSRQKIHGMNFRVICKWMRMAGVDHIHAGTVVGKLEGDPLMIQGFYNTLLLPYLDVNLLQGIFFEQDWASLRKVTPVASGGIHCGQMHQLLDYLGVDVVLQFGGGTIGHPDGIQAGATANRVALEXXXXXXXXXXXXXXXXPQILQDAAKTCGPLQTALDLWKDITXNYTSTDTADFXETRTANV

SEQ ID NO: 8246 - protein, 430 aa, Yersinia pestis KIM
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 8247 - protein, 358 aa, Helianthus annuus
MEDYLGQNSSSSNTGTTSTTFLYGSGGVAPDTSCLYGRGGNESDPGHGGFHHPDQYHHPMVKIETEKFHNYPPSMVNFHNEDEALKAKIISHPHYSNLLQAYMDCQKVGAPPEVVGRLTAVRQEYEARQRANLGCRENYKDPELDQFMEAYYDMLIKYKEELTRPIQEAMEFMRRIESQLSTLTISSSSSSSPAGRIFISPDESKCEVIGSSDEEQENTSGGETEVAEIDPRAEDRELKNHLLRKYSGYLSSLKQELSKKKKKGKLPKEARQKLLSWWELHYKWPYPSESEKVALAESTGLDQKQINNWFINQRKRHWKPSEDMQFMVMDGLHPQNVATALYMGDHHYMGDGPYRLGP

SEQ ID NO: 8248 - protein, 310 aa, Triticum aestivum
MALEAVEFSQGHFGYGQAPGLGPWCDMVGAGGFFEDCWDQQLLAAPVAPNAEDQWEPVSSWDQSEASSEGKAAAPEPAMAAAATGRRKRRRTKIVKNKEEVESQRRTHIAVERNRRRQMNEYLAALRSLMPQSYAQRGDQASIVGGAINYVKELEQLLQSLEVQKSVKIRSRPPPVAGSLSCPQYSTSCNATQATASDGGSGADSSGLKSEAGVADIEVTMVEGHASLKGLSRRRPRQLLRLLAGLQQLRIPPLHLNVTTVDAMVLYSFSLKVEDGSKLSSVEDIAAAVHEILARIQREEEEAGRLSSSS

SEQ ID NO: 8249 - protein, 369 aa, Mesorhizobium loti
MSDAKLQSVLSSLSQVARQLDALPSDRPAPGSSWVKLNTNENPFPLPAIIMQSAIAALERQYLYPEDDNISLREAAANAYSVSMDQVIAGNGSSELLGLVYRAFLAPGDSVAMMSPGFSFNRKLATLQGAQFVEIKFSEDHSLPMEQLLFGPAKDAKFILLANPNNPTGTFVPVADIERLVAKSDRLIVLDEAYVDFAPENGLRLINRYSNLLVLRTFSKSYAAAGVRVGFGFGHPEIIGRLRNIQNVFNMNVIGQAVGISVLAHRAAYADNHRHIRHERRRVTLALSQLGFSVIPSHANFLLARVPTGQDGLWWQSAFARQKILVAVFPDKGLENYIRVSIGTKEQMDAFLRAASRISRILNMSRPPY

SEQ ID NO: 8250 - protein, 522 aa, Streptomyces coelicolor A3(2)
MSRDEATVGRVMAQVAMVMNLDKCIGCHTCSVTCKQTWTNRTGVEYAWFNNVETKPGVGYPRRYEDQDRWKGGWMLDRRGRLVLRSGGRVRRLLSLFSNPDLPSLEDYYEPVTYDYDNLVGAPAGPDMPVARPRSVLTGRPTSITWGANWEDGLGGAPENAGADPNLSGEWAERVRFEFEQTFLFHLPRLCEHCLNPACVSACPSGAMYKRVEDGIVLVDQDKCRGWRMCVTACPYKKVYVNHATGKAEKCTFCFPRIEAGQPTVCSETCVGRLRYLGLLLYDADRVGEAAATPDEKDLLDAQRGVFLDPADPDVIAAARESGIPEDWLAAARRSPVYDLVARHKVALPLHPEYRTLPMVWYVPPLSPVLDAVDAAGGNQDDPDHVFAAVTRLRIPLEYLAELFTAGDTDVVGGVLMKLTALRSYMRARTLGEDGDEAALKAVGLTAREAEDLHRLLAVAKYEDRYVVPAAHREDAAALSGMEDRCPVETSGDPQPAGSGGRIMLGIPTLRRSSAASTGDSA

SEQ ID NO: 8251 - protein, 275 aa, Glycine max
MSSMLRFPFSFPQPRRPQFPRPFTAFAAAVAGASAAVVAVSSSDRSFLRNALNSFFSSDLSMPLWGSLSLADSGVSVVESKTGTSFPSILDSSQKLCGIGLRKKNVLGLKNIDVYAFGVYADDEDIKRHLSEKYGKLSASELQGNKEFTEDLMESDISMTIRLQIVYGRLSIRSVRSAFEVSVGSKLQKFGGSDNKELLQRFTSQFKDEFKIPRGSVIHLSRDKGHVLRTSIDGQEVGSIQSKLLCKSILDLYFGEEPFDKQAKEEIELNMASYL

SEQ ID NO: 8252 - protein, 327 aa, Pseudomonas stutzeri
CIGCHTCSITCKNVWTSREGMEYAWFNNVETKPGIGYPKEWENQDKWKGGWVRNGDGTINPKIGGKFRVLANIFANPDLPTIDDYYEPFDFDYQNLHTAPISEHQPVARPRSLISGQRMEKIEWGPNWEEILGTEFAKRRKDKNFDKVQADIYGQYENTFMMYLPRLCEHCLNPACAASCPSGAIYKREEDGIVLIDQEKCRGWRMCISGCPYKMIYFNWKSGNSEKCIFCFPRIEAGMPTVCAETCVGRIRYLGVLLYDADRIHEVASTVNEQDLYAKQLEIFLDPFDPKVIEQALNDGVPMSVIEAAQKSPVYKMAVDWNAWPCR

SEQ ID NO: 8253 - protein, 362 aa, Streptomyces coelicolor A3(2)
MTTPTIELKPSAHPLSDSERAAILANPGFGRHFTDHMVTIKWTEGRGWHDGQLVPYAPLSLDPATMVLHYAQEIFEGLKAYRRPDGSVATFRPEKNGARFQASSRRLGMPELPVDTFIEACDALVAQDEKWVPAHGGEESLYLRPFMIATEVGLGVRPANEYLFIVIASPAGAYFPGGVKPVSIWVSEDRVRAVPGGMGDAKTGGNYAASLLAQAEAAAKGCDQVCYLDAIERKWVEELGGMNLYFVYGNKIVTPSLTGSILEGVTRDSLLTVARDLGYEAEEGRVSVDQWQRDSENGTLTEVFACGTAAVITPVGTVKRAGAQWQQSGGETGEVTQRLRDALLDIQRGTVADPHGWMHTLA

SEQ ID NO: 8254 - protein, 462 aa, Zea mays
DLYQQSIAAVCNLDWPKSNFLVQVLDDSDDPLTQTLIREEVAKWQQQGARIVYRHRVLRDGYRAGNLKSAMSCSYVKEYEFVAIFDADFQPHPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKIAFWKKANLIFLFFLLRKLILPFYSFTLFCIILPMTMFVPEAELPDWVVCYVPALMSLLNILPSPKSFPFIIPYLLFENTMSVTKFNAMISGLFQLGSAYEWVVTKKSGRSSEGDLIALAPPKEPVKLHATRTGSAPNLDAVAKEEHLAAASRKDAAAAATTVKKKKEKHNRIYKKELALSMLLLTAAARSLLSKQGIHFYFLLFQGVSFLLVGLDLIGEQVE

SEQ ID NO: 8255 - protein, 260 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEVYEYITYDANKHISLASLPGDAERTIITSSLSKTYSVTGEHNSEFAAQFVVTQPAIEIARLVR

SEQ ID NO: 8256 - protein, 364 aa, Populus kitakamiensis
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKMAMKKILESYKGFEGLASLVDVGGGTGAVVSTIVSKYPSIKGINFDLPHVIADAPAFPGVENVGGDMFVSVPKADAVFMKWICHDWSDEHCLRLLKNCYDALPENGKVILVECILPVAPDTSLATKGVMHVDAIMLAHNPGGKERTDKEFEGLARGAGFKGFEVMCCAFNTHVIEFRKQA

SEQ ID NO: 8257 - protein, 312 aa, Oryza sativa; identical to SEQ ID NO: 2310

SEQ ID NO: 8258 - protein, 617 aa, Triticum turgidum
MASWFETYHHPSKGKGKRRILRVQTRDTREQLCAHLCLLPLLLTAGENSYPVIVMIGTRVLAHSRVDPAIRWGAAAHGFVVIAPKKREAGQETSTSERKKTKRKWRRNFCGWTSHEAKEPSTSETKKTKRKWGRNFCGWTSHEAEEPLTSETKKTKRKWGRNFCGWTSHEAEEPSTSETKKKRKNGASSSEPDKKRWFKTKIWRKKKAKNKQLATLVKEISLPNSPKARAAAGEILRIGNHNIPSRVFTYSQLSDATNSFSQENLLGEGGFGRVYKGYIPETMEVISIPSPSFLFYVSLSWHLKMLCYIQQQHLPDVNYVIAVKQLDKDGLQGNREFLVEVLMLSLLHHPNLVTLLGYCTECDQKILVYEYMPLGSLQDHLLDLTPKSQPLSWHMRMKIAVDAARGLEYLHEVANPPVVYRDLKASNILLDGNLSAKLADFGLAKLGPVGDKTHVTTRVMGTYGYCAPEYAMSGKLTKMSDIYCFGVVFLELITGRRAIDTTKPTREQILVHWAAPLFKDKKKFTKMADPKLDSKYPLKGLYHALAISSMCLQEEASSRPLISDVVTALTFLADPNYDPPDDIEPLPITVPDFDRGISLGEPEEVKEKFEGKQVEDS

SEQ ID NO: 8259 - protein, 221 aa, Zea mays; identical to SEQ ID NO: 5870

SEQ ID NO: 8260 - protein, 205 aa, Triticum aestivum
  unsure (1)..(205): unsure at all Xaa locations
MYFRPPPKGPEWGGDAEAGQAARPLYPMMLESPQLRWAFVRKVYTILSIQMLLTIAVASVVVFVRPVALFFVSSPAGFGLYIFLIILPFIVLCPLYYYYQRHPVNLLLLAPLXVAISFAVGLTCAFTKGEVILESAILTAXLVVEPDRRTPFWAASRGHDFSFLGPFLFAAVMILMVFALIQAFFPLGRISLMVYGGLAALVFCG

SEQ ID NO: 8261 - protein, 99 aa, Triticum aestivum
  unsure (1)..(99): unsure at all Xaa locations
MYKKSVVNGGGARIEPQRSRGRDGXNEVFFRTXKSIPTQLKKYHVLLNRHCQSCGCNXIAFLFDGRRLRGKQTPDELEMEXGDEIDAMLHQTGGCFPAP

SEQ ID NO: 8262 - protein, 356 aa, Mucor circinelloides
MGCCASVEESDSVGKLRNEEIDGQLRMEKLNNKNEVKLLLLGAGESGKSTILKQMKLIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEALTLFDSICNSRWFERTSTILFLNKTDLFKQKLPTSPLVDYFPDYKGANDDYEEASNYIMQRFISLNSSAEKQVYTHLTCATDTEQVKFVMAAVNDIVLQTNLRDVGLI

SEQ ID NO: 8263 - protein, 454 aa, Methanosarcina barkeri
MKLKSINPYTEKINWAYDSFSIGECRARIEKSRTAFSLWDSLPVEEKAKHFKTAAEILRESTDTYAEIITKEMGKPVRQSKNEVQKCAQLCDYYAENSTELLKDEIVDIGTEKSYVTFEPLGVIFGIMPWNFPFWQVFRFAIPAMCAGNVCVLKHASNVPKSALEIENILLEAGFPENVFNTLLIDSKTAMQILKEELVDGISFTGSVGAGSKIGKLAGRGIKPVVLELGGSDPFIVLEDANIERAAQAAVKSRFLNAGQSCTAAKRLIVVEDIVMDFIESFEFKVKELKIGDPMDEKTDIGPLAKKEFLGSLERVLKDAKKKGAKPHVYGEEHKKGFFFRPTIIPAASTDMEVCRTEIFGPIAPVITVKDENEAVAIANSTEYGLGAKIWSGDLDRAERLAKRIKSGSVSINGMIKSDPRLPFGGTKKSGVGRELSHYGLREFVNIKTVVVNR

SEQ ID NO: 8264 - protein, 479 aa, Cryptopleura corallinara
RLKNERYESGVIPYAKMGYWDPNYVIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIKGFYDTLLLPYLEVNLPQGIFFKQDWASLRKVTPVASGGIHCGQMHQLLDYLGNDVVLQFGGGTIGHPDGIQAGATANRVALESMVIARNEGIDYVAEGPQILRDAAKTCGPLQTALDLWKDITFNYTSTDTADFVETPTANV

SEQ ID NO: 8265 - protein, 203 aa, Lilium longiflorum
QSSQSMESAMITLDLPVIAAYRQLMEIPGETSNSLGDPSQSYALDAPTLTYALDAPTRSYVLDAPTLSYAHDAPTLTYALGAPASTYALDAGAMASTAADVKDLPAAYVFVVDMPGVGSGDLKVKVEGDNVLLISGERKREEEGVYLCIERRVGKLTKMFVLPENANTEAVSAVCKDGVLTVTVEKRPPQEPKKPKVIEVKVA

SEQ ID NO: 8266 - protein, 228 aa, Rhodobacter capsulatus
MTFDRSIKIAPSILSADFADFGREIQAIEAQGADWVHVDVMDGHFVPNLTFGPPAVAAFRKHVKTVMDVHLMISPVDAYIDAYAQAGADVLTAHVEAGPHIHRTLQAIRAAGMKSGVAINPGTPAEAIEHVLDIADVVCVMTVNPGFGGQKYIDMTAKVRKLRAMIGDRPVHIEIDGGMDPVTAPLMAAAGADVFVAGSGVFKGGSVSTPEVYGKNIAAIRAAAQAAL

SEQ ID NO: 8267 - protein, 131 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 8268 - protein, 337 aa, Cochliobolus heterostrophus
MVVKVGINGFGRIGRIVFRNAIEHNDVDIVAVNDPFIEPHYAAYMLKYDSTHGQFKGDIKVDGNNLTVNGKTIRFHMEKDPANIPWSETGAYYVVESTGVFTTTEKAKAHLKGGAKKVVISAPSPDAPMFVMGVNHETYKPDIEALSNASCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGSLNGILGYTEDDIVSTDLNGDNRSSIFDAKAGISLNKNFVKLVSWYDNEWGYSRRVLDLLVYIAKIDGNA

SEQ ID NO: 8269 - protein, 160 aa, Zea mays
  unsure (1)..(160): unsure at all Xaa locations
MAAAAAAPASVAPSAASEAAHRKRSAPSVDASDLERAGXKHVLAVDDSSVDRAVIARILRGSRYRVTAVESATRALELLALGLLPDVSMIITDYWMPGMTGYELLKHVKESSALRGIPVVIMSSENVPTRITRCLEEGAEGFLLKPVRPADVSRLCSRIR

SEQ ID NO: 8270 - protein, 194 aa, Saccharomyces cerevisiae
ISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEVKHQSKYSDKSKEKLLKKRKKKERGCNNL

SEQ ID NO: 8271 - protein, 84 aa, Chloroflexus aurantiacus
MTRQDLASLIRNIPDFPIPGIQFKDITTLIGNGQAFSEVIDRLHERYQNQQIDAVVGIESRGFIFSAPLAYRLGVGLVPIRKPG

SEQ ID NO: 8272 - protein, 389 aa, Oryza sativa
MQKQLRRLRTLGRGASGAVVWLASDDASGELLAVKSAAGEGGAEQLRREGRVMSGLCSPHIVPCLGSRAAAGGEYQLFLEFAPGGSLADEAARSGGRLAERAISAYAADVARALAYLHGNSLVHGDVKARNIMVGADGRAKLADFGCARRTDSERPIGGTPAFMAPEVARGEEQGPAADVWALGCTIIEMATGRVPWSDMDDVFSAVHRIGYTDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTGEVHLPEEVFGRRRLL

SEQ ID NO: 8273 - protein, 755 aa, Betula platyphylla
MWKLKIAEGGPGLVSGNDFIGRQHWEFDPDAGTPQERAEVEKVREEFTKNRFQMKQSADLLMRMQLRKENPCQPIPPPVKVKETEVITEEAVITTLRRSLSFYSSIQAHDGHWPGESAGPLFFLQPFVMALYITGDLNTIFSPAHQKEIIRYLYNHQNEDGGWGFHIEGHSTMFGSALSYIALRILGEGLEDGEDGAMAKSRKWILDHGGLVAIPSWGKFWVTVLGLYEWSGCNPLPPEFWFLPDIFPIHPGKMLCYCRLVYMPMSYLYGKRFVGPITGLIQSLRQELYNEPYHQINWNKARSTVAKEDLYYPHPLIQDLLWGFLHHVAEPVLTRWPFSMLREKALKAAIGHVHYEDENSKYLCIGSVEKVLCLIACWAEDPNGEAYKLHLGRIPDNYWVAEDGLKIQSFGCQMWDAGFAIQAILSCNLNEEYWPTLRKAHEFVKASQVPENPSGDFKAMYRHINKGAWTFSMQDHGWQVSDCTAEGLKVAILFSQMPPDLVGEKIEKERLYDAVNVILSLQSSNGGFPAWEPQRAYGWLEKFNPTEFFEDTLIEREYVECTSPAVHGLALFRKFYPRHRGTEIDSSIYRGIQYIEDVQEPDGSWYGHWGICYTYGTWFAVGALAACGRNYKNCPALRKSCEFLLSKQLPNGGWGESYLSSQNKVWTNIEGNRANLVQTAWALLSLIDARQAEIDPTPIHRGVRVLINSQMEDGDFPQQEITGVFMRNCTLNYSSYRNIFPIWALGEYRRRVLFA

SEQ ID NO: 8274 - protein, 388 aa, Trichodesmium erythraeum IMS101
MKAMILAAGKGTRIRPITYRIPKPMIPILQKPVMEFLVELLRKHGFDQIMVNVSHLAKEIENYFRDGQRFGVNIAYSFEGRIEDGNLIGEALGSAGGMRRIQDFYPYFDDTFIVLCGDALIDLDLTKALQRHKEKGAMATVIMKSIPREQVSSYGVVVTDETGRIQSFQEKPKVEEALSTNINTGIYIFEPEVLDCIPSGVEFDIGSQLFPKLVEIGAPFYGVAMDFEWVDIGKVPDYWQAIRDVLIGKVKNVSIPGKEVSPGIYTGLNVAVNWDKIDIKRPVYIGGMTRIEDGAKIVGPSMIGPNCWICSGATVDSSVIFEYSRLGPGVRLVDKLVFGRYCVDKTGSSIDVQAASLDWLITDTRHPFPSPPPAEHETIKDILQENGG

SEQ ID NO: 8275 - protein, 1230 aa, Candida albicans
MSILSENNPTPTSITDPNESSHLHNPELNSGTRVASGPGPGPEVESTPLAPPTEVMNTTSANTSSLSLGSPMHEKIKQFDQDEVDTGETNDRTIESGSSDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSSSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 8276 - protein, 292 aa, Streptomyces venezuelae
MKGIVLAGGSGTRLHPATSVISKQILPVYNKPMIYYPLSVLMLGGIREIQIISTPQHIELFQSLLGNGRHLGIELDYAVQKEPAGIADALLVGAEHIGDDTCALILGDNIFHGPGLYTLLRDSIARLDGCVLFGYPVKDPERYGVAEVDATGRLTDLVEKPVKPRSNLAVTGLYLYDNDVVDIAKNIRPSPRGELEITDVNRVYLERGRAELVNLGRGFAWLDTGTHDSLLRAAQYVQVLEERQGVWIAGLEEIAFRMGFIDAEACHGLGEGLSRTEYGSYLMEIAGREGAP

SEQ ID NO: 8277 - protein, 242 aa, Bacillus subtilis
MPYLKRVLLLLVTGLFMSLFAVTSTASAQTGGSFFDPFNGYNSGFWQKADGYSNGNMFNCTWRANNVSVTSLGEMRLALTSPSYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDERLGSYNGVNPLYAHYDWVRYTKK

SEQ ID NO: 8278 - protein, 334 aa, Glycine max
  unsure (1)..(334): unsure at all Xaa locations
MAGGQLGVLNALDVAKTQWYHFTAIVIAGMGFFTDAYDLFCISLVTKLLGRLYYTDITNPKPGVLPPNVQAAVTGVALCGTLAGQLFFGWLGDKLGRKRVYGLTLMLMVLCSIASGLSFGDTPKGVMATLCFFRFWLGFGIGGDYPLSATIMSEYANKKTRGSFIAAVFAMQGFGIMAGGIVALIVSSAYDHKYDLPSYKDNPAGSKVDSLDYVWRIILMFGAVPAALTYYWRMKMPETARYTALVAKNAKQAASDMSKVLQVEVEAEEDKLQHMVESENQXMGLFSKEFAKRHGLHLVGPTXTWFLLDIAFYTRTXFPKDIXTAIGWISSAQT

SEQ ID NO: 8279 - protein, 255 aa, Zea mays
MAATIQSVKARQIFDSRGNPTVEVDVCCSDGTFARAAVPSGASTGVYEALELRDGGSDYLGKGVSKAVDNVNSIIAPALIGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTRQVVIWNGMCCF

SEQ ID NO: 8280 - protein, 713 aa, Bacillus sp. 17-1
MKKISKLTTALALSLSLALSLLGPAHAAPDTSVSNKQNFSTDVIYQIFTDRFSDGNPANNPTGPAFDGTCTNLRLYCGGDWQGIINKINDGYLTGMGVTAIWISQPVENIYSVINYSGVNNTAYHGYWARDFKKTNPAYGTIADFQNLIAAAHAKNIKVIIDFAPNHTSPASLDQPSFAENGKLYNNGRDEGGYTNDTHNLFHHNGGTDFSTTENGIYKNLYDLADLNHNNSTVDTYLKDAIKMWLDLGIDGIRMDAVKHMPFGWQKSFMATVNNYKPVFTFGEWFLGVNEVSAENHKFANVSGMSLLDFRFAQKVRQVFKDNTDNMYGLKSMLEGSATDYAQMEDQVTFIDNHDMERFHNNSANRRKLEQALAFTLTSRGVPAIYYGTEQYMSGGNDPDNRARIPSFSTTTTAYQVSKKLAPLRKSNPAIAYGTTQERWINNDVLIYERKFGNNVAVIAVNRNVNTSASITGLVTSLPAGSYTDVLGGLLNGNNLTVGSGGSASIFTLAAGGTAVWQYTTAVTAPTIGHVGPMMAKPGAAVTIDGRGFGATKGTVYFGTTAVTGANITAWEDTQIKVKIPAVAGGVYNIKIANSAGTSSNVHDNFEVLSGDQVSVRFVVNNATTALGQNVYLAGSVSELGNWDPAKAIGPLYNQVIYQYPTWYYDVTVPAGKTIEFKFLKKQGSTVTWEGGSNHTFTAPTSGTATINVNWQP

SEQ ID NO: 8281 - protein, 487 aa, Bacillus subtilis subsp. subtilis str. 168
MAEIRKLKNYINGEWVESKTDQYEDVVNPATKEVLCQVPISTKEDIDYAAQTAAEAFKTWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 8282 - protein, 182 aa, Oryza sativa
  unsure (1)..(182): unsure at all Xaa locations
WIPRAEDRHEGCERKQADADAYMYSEEKGKLKEKYEKELKXPGLGSSCMLKRQQXSDKELKKEKLKSAAVIKELQEXNAEQKLRDELQQKDEETSQQVEKVRELAKAELAAALAKERASQIEQIAEANLNIDALCMAFYARSEETRQSHSVHKLALGTLALEDALSNXSPIRTRXGQLRKSL

SEQ ID NO: 8283 - protein, 276 aa, Streptomyces lividans
MNKVWLITGASSGFGRAIAEAALADGDVVVGAARRPEALDDLVAAHPDQMEALRLDVADTAAAGDAVRDVVARHGRVDVLVNNAGRTHVGALEETGEDELRALFDVHVFGPAALTRAVLPSMRERRSGAIVQMSSMGGQMSFAGFSAYSGTKFALEGMSEGLADEVRDFGIKVVIVEPGSFRTGLFEAGNAGISADSGVYAKVGETRGMIAAGDGSQPGDPARAAAVIRAALAAEHTPLRLPLGADGVTAVLGHLDRVREEVETWEKQTRATAFDD

SEQ ID NO: 8284 - protein, 415 aa, Kluyveromyces lactis
MKVGELLESSGAGGSRSIIAYTNDKNAGFETEMDSILPSDDLKQGSLHSKNSHGNDVKIVPDEDEVITRRTVVKGHSNPRSQLLFHAVTPEIVGNGSFGVVFRTKVKETGRMLSLRRFYRIRRFKNRELEIMKLISHPNLIDLKYYFLEQSDQELYLNLIVDYMPMSLYQRLKEFISLHQPMDRYEIKIYMFQLFKSLNYLHQVVNVCHRDIKPQNILVDPDTLLLKICDLGSAKQLKPNEPNVSYICSRYYRAPELIFGATNYTTKIDIWSAGCVMAELLLGQPIFPGESKIDQLVEIIKVLGTPTREEICSMNENYSEHKFPQIRPIPLNRIFKKETQETIDLLYHIMKYDPNIRYSALQCMFNSTYFTDIVSNTGSDSNLSLIDSLPLLHFEESELQGLSSNDIYRLTGKLI

SEQ ID NO: 8285 - protein, 321 aa, Triticum aestivum
  unsure (1)..(321): unsure at all Xaa locations
MVLPSTLMVSLSTIFTSALKVPSIEVVSNRDPLKLPWAELGIDIVIEGTGVFVDGPGAGKHLQAGAKKVIITAPAKGADIPTYVXSGVNEGDYGMRSPTSSSNASCTTNCLAXPFAKALDEDFGSLKGXMTTTTPYTGDQRLLDASHRDLRRARAAALNIVPTSTGAAKAVSLVLPQLKGKLNGIALRVPTXPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 8286 - protein, 366 aa, Filobasidiella neoformans
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 8287 - protein, 371 aa, Schizosaccharomyces pombe
AQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDADNFGCTFGGLFVLEFLGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFGHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 8288 - protein, 559 aa, ASPERGILLUS NIDULANS FGSC A4
MRRLTCLSAFFLASASVAVASPSAEQWAERSIYQVMTDRFARPAGSPGDKPCDPYRYCGGSWTGVIDKLDYIQDLGFTAVQISPVVENIPDNTVYGEAYHGYWPQNMYALNEHFGTADELRKLSKELHKRGMYLMVDVVINDMAQAVNSSLDSGSNINWSRLIPFNDKKYYHPFCRIEDWNNPDESKNCWFSTEVVALPDLKTEDESVVSMIEIWVKGLVGNYSIDGLRVDATKHMDEAYLTSFSEAAGVFTMGEVYTEDTDAVCKYEEVLSGLLNYPMYRPMVQAFTAGNMPGLAENVRAVNSKCKDFTRLATFTENHDTPRFASLINDTTLARNAMAFNILSDGIPVVYQGQEQHMKGPYAPYNREPLWKTSYNTNGSLYKTTSTLNKLRNHAIRLDKHYVSSHSEELYLDGSTYVTRKGSEGSQIVSVFSNQGSQGGPYNLRIPRAYKPGTEVIEVLSCKRVTADNEGQLVAKMDKGEPKAFFPVKKMNGSGLCGFKGRRGRKGAICSSAGKGNGTRKNDTVNEGTVEQTSAGNGASVTIPMVLLSICVGLAGLFL

SEQ ID NO: 8289 - protein, 335 aa, Achromobacter xylosoxidans
  unsure (1)..(335): unsure at all Xaa locations
TIRVAINGYGRIGRNILRAHYEGGKSHDIEIVAINDLGDPKTNAHLTRYDTAHGKFPGTVSVNGSYMVVNGDKIRVDANRNPAQLPWGALKVDVVLECTGFFTTKEKAGAHIKGGAKKVIISAPGGADVDATVVYGVNHGTLKSTDTVISNASXTTNCLAPLVKPLNDKLGLQDGLMTTVHAYTNNQVLTDVYHEDLRRARSATMSMIPTKTGAAAAVGDVLPELDGKLNGYAIRVPTINVSIVDLSFVAKRNTTVEEVNGILKAASEGELKGILDYNTEPLVSVDYNHDPASSTVDASLTKVSGRLVKVSSWYDNEWGFSNRMLDTTVALMSAA

SEQ ID NO: 8290 - protein, 356 aa, Oryza sativa
  unsure (1)..(356): unsure at all Xaa locations
MRHISSLLQGLARSLSVGKERKGGDGDDGKAAAATATAVLRTSGTLWGEGSETFAAVCSRRGEKGINQDCSIVCEGFGCEEGSVLCGIFDGHGQWGHYVAKAVRESLPPALLRRWREAVTLAALIDGGEKRLCECRPDLWRQSYLAACAAVDAELRASRRLDAVHSGCTALSLVKHGDLLVVANVGDSRAVLATASPDDGGGARLAAVQLTVDFKPNLPQERERIMECNGRVQCXLADEPGVHRVWRPDREGPGLAMSRAFGDYCVKDYGVISAPEVTHRRITAQDHXFVILATDXGVWDVVSNEEAVQIVASAPEREKAAKRLVEFAVRAWRRKRRGIAVDDCSAICLFFHSPPS

SEQ ID NO: 8291 - protein, 203 aa, Oryza sativa
  unsure (1)..(203): unsure at all Xaa locations
CLAPFVVSQLRPEIQVAAQNCWAKKGGAFTGEVSAEMLVNLSIPWVILGHSERRSLLGESNEFVGDKVAYALSQGLKVIACVRLXTVEAGETXNPIAERMKGXQKTWTLWVVAYEPVWAIGTGKVATPDQAQEVHDGLRKWLAANVSAEVAESTRIIYGGSVTGANCKELAAKPDVDGFLVGGASLKPEFIDIINSATVKSRP

SEQ ID NO: 8292 - protein, 1003 aa, Oryza sativa
MAEEGQRGGYSRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGCESTRLYGSFNKHETGCNQDKAKRGNGVPGYICSVVNFVLCADFESRHPVDTIRQYKSRQEGARLDSSPQHCRRSHHLTWQIRYQRVPVRPAPGASERSAAMTWNKAPAADAEAGGGGDTGHARLRELGYKQELKRDLSVLSNFAFSFSIISVLTGITTLYNTGLSFGGPATMTFGWFVAGAFTMTVGLSMAEICSSFPTSGGLYYWSARLSGKRWAPFASWITGWFNIVGQWAVTTSVDFSLAQLIQVIILLSTGGNNGGGYMASKYVVIAFHAAILLSHAAINSLPITWLSFFGQFAAAWNMLGVFVLMIAVPTVATERASAKFVFTHFNTENNAGIHSNFYIFVLGLLMSQYTLTGYDASAHMTEETKNADRNGPIGIISAIGISIIVGWGYILGITFAVKDIPYLLNPENDAGGYAIAEVFYLAFKSRYGSGIGGIICLGIVAVAIYFCGMSSVTSNSRMAYAFSRDGAMPLSSVWHKVNKHEVPINAVWLSALISLCMALPSLGSLVAFQAMVSIATIGLYVAYALPILFRVTLARKHFVPGPFNLGRCGVAVGWAAVLWVATITVLFSLPVSYPVTKDTLNYTPVAVGGLFLLWEMEESSSMIGGVSGGRRSITEEQAAGAEAEADEEELEPLFDYSRVQPTMAFSFDDTDIEKSDIFVHCNKRRKVADGDGDANADEKGDKGEQKAAKAAAVVDLGEEDWLPPPPPPKPKSTVTDESEQSSVLKELRYKPVHGSILLQKQAMAKFAESADDFLEKLAQTARQKVEARIPTEHIDLDKSPERHEAREKVVVTVQDKAGHHQFRLYKDEKFGKLFRAYAKKVNLSVADLTFAFDGDKVDAESTPEDLGLEDEDMVEVLHKTR

SEQ ID NO: 8293 - protein, 765 aa, Phycomyces blakesleeanus
MATLLIDNYDSFTYNVYQYLCSQGADVVVYRNDKITVDEIVKLNPVNIVISPGPGHPSHDAGVSRDVISYFAGKLPILGICMGEQCIFEVFGGTVSYAGDILHGKTSTIKHDNRGLFKNVPQDNQVTRYHSLAGMPSTLPEVLEVTATTDDGVIMGVRHKKYTVEGVQFHPESILCEHGHTMISNFLSLRGGNWDENPAAGVLAQKVPAAATEKAAQEASPAISTPPTCSTILSRIYAQRVKDVQAAKEVPGQSQADLQKLLNLHIAPPLRDVVNRLKESSPALMAEVKRASPSKGNIDITVNAAEQALQYALAGASVISVLTEPKWFRGSLNDLRQVREACPLLPNRPCILRKTFLLDTYQILEARLYGADTVLLIVAMMSDEDLRELYQYSVSLGMEPLVEVNNAEEMARANAVGAKLIGVNNRGLHSFDVDMETTSRLAEMVPEGTILCALSGISTRADVETYVSQGVHGLLVGEALMRAWNLKEFVAELLGYKKKDPVPHTPVSRQVQVKICGISSVEAAVEAATAGADLVGLIFAEKSKRQVTVAKAREIVDALHKLPTRSSQLPVKSQKSIDWFDVQTEMVEQRVPWRPLVVGVFVNQSIEYMSQVAVEAGLDLIQLHGTESAEIARFLPVPVIKAFHMDASSFHAGQIPYVTQPGNNQLLLLDAKVPSLPMDRQGGLGQKFDWTIAQDIVNVKRPGCSKEQTFPVILAGGLDPSNISEAIQQVRPWAVDVSSGVETDGKKDLKKIRAFVEKAKSINLQ

SEQ ID NO: 8294 - protein, 311 aa, Trichodesmium erythraeum IMS101
MTHSPIILGVVGDSAAGKTTLTRGVAQVLGPENVTVICTDDYHRYDRKQRAEIGITALHPDCNHLDIIQQHLSLLSTGQPILKPIYNHSTGKFDPPEYIKPKKFVIVEGLLGYSTRGARDCYHVKVYLAPPEKLRAKWKVKRDTMKRGYTEAEVLKQMEKREADSDAFIRPQRKWADVVVSFYPYSSDINSSQLNVRLLLRPTIPHPDFLEILDQGSPSFQPAVRLGLDRDMGKPVDVLEIDSNATKAQVNELEIILCKEMPHLKDFCSLETHPDIGKLVGTTGELLQSYPLALTQLLISYHMIKATNIYL

SEQ ID NO: 8295 - protein, 249 aa, Guillardia theta
MICSKEEKNSTQGISQQSIDDIILRKTNNTSNNVFFQGKNLHAFDVIRTRGPSTEAQSSVVPFRAVRANEITPNIQNVVSTVSLGIQLDLKRIALKARNAEYNPRRFAAVIMRIRDPKTTALIFSSGKMVVTGAKSEDSARVACKKYARIIQRLGYGHAKFIDFRIQNIVASCDVRFPIRLESLAHAHNQFCSYEPELFPGLIYRMITPKVVLLIFVSGKLVLTGAKQRNDIFQAFSNIYSVLCLYKKT

SEQ ID NO: 8296 - protein, 473 aa, Laurencia intricata
YESGVIPYAKMGYWDPNYVVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDGNINSQPFMRWKERFLYSMEAVNRSIAATGEVKGHYMNITAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYNTLLEPYLKVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 8297 - protein, 213 aa, Yersinia pestis CO92
MTDKAHQCVIIGIAGASASGKSLIASTLYRELREQVGDQHIGVIPEDGYYKDQSHLSMEERVKTNYDHPSAMDHNLLLEHLQALKAGKPVELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 8298 - protein, 117 aa, Zea mays
  unsure (1)..(117): unsure at all Xaa locations
MPVFGEEDKKPAEGTAHINLQVKGQDGNEVFFRIMRSTQLNKLXMNAYCDRQSVDMNAIAFMIDGRRLHGEQTPDELQVQDRDEIDSMLHQTGCSAPSITYTTRFALRPAYYARKGV

SEQ ID NO: 8299 - protein, 155 aa, Lycopersicon esculentum
MDLRLMGIDNTPLFHTLQHMMEAAGEDSVNAPPKKYVRDAKAMAATPVDVKEYPDSYVFVVDMPGLKSGDIKVQVEEDNVLLISGERKREEEKEGVKFIRMERRVGKFMRKFSLPENANTDAISAVCQDGSLTVTVQKLPPPEPKKSKTIQVKVA

SEQ ID NO: 8300 - protein, 263 aa, Zea mays
MGAFFSKQVDRRKLVAAEKRALATRLSSSGDTFPGSEHRPADRKRWMAELGAGRLRVHQVVWPGTHDSATDRIGVPFVTRPFAQCQSLSVYEQLALGARVLDVRVQKGRRVCHGVLATYPVDVVLDDVARFLGETESEVVVLEVRTEFGHEDPPEFGRFLVERLGEHLLIPQDEAVFHKTVAELLPRRVICVWKPRRSPAPGPGEPLKFLGQQPPVAGRGFLYRVENTVTPRPDNPVVCVWPVTRRIHGYARMFIAEVFGRRG

SEQ ID NO: 8301 - protein, 166 aa, Desulfitobacterium hafniense
MLRVGVITASDKGSQGQREDLSGAVLKELVKEIDGEVVLYTILPDDQELLAQTMKKWADEEGLDLILTTGGTGFSLRDVTPEATTAIADRMVPGIAEVMRYESYKITPKAMLSRAVAALRKQTLIINMPGSPKACKECWAALVPALPHGIQILKGEASECAVPVHQ

SEQ ID NO: 8302 - protein, 342 aa, Archaeoglobus fulgidus DSM 4304
MRDVVRFINPYDPGLFPEDFPDKEVVNLSSNENPYEPSEEVREAYLRAVKYIPRYPKADYARLKKALAEYTGFEVENIAVGCGASELISCICNVLLEELDRVVIPMPSYTLYSIYAMLRSASISFPVFEGYRVDPDVIAEERPKLVFLCSPNNPTGNSLSREIVQKVAESAEYVVLDEAYVEFSDDSKIEMVRDYNNLIVLRSFSKFFGLAGMRVGYAVCSAEIAEAIEKVRLPFGISYPAVETAIAALRSLDYYKKVRDRIVRERERLIEKLKEIEWLEVYPSDANFVLVKANKEGVVEKLAEKGFIVRDASVMGLEGLYIRITVGKREDNDRLIEALREI

SEQ ID NO: 8303 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQVRQLHRFKPPGCEESGKA

SEQ ID NO: 8304 - protein, 406 aa, Brucella melitensis 16M
MSEEFHKIRRLPHYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 8305 - protein, 397 aa, Methanosarcina acetivorans C2A
MGRIFKERTSVDEALQLFLENISPLRHAEEVPLEACTGRVLAETVVSGRDIPHYRRAAMDGYAVRAADTPGASPANPVLLQLSDSIEEGTSMWVHTGAALPEGADAVVMVEDTVTVGDMVEIRAQVYPGRNVGQIGEDIRKEELVFKEGHLLRPCDAAVLASLGLDRVKVFRKPLVAVIPTGDELISRKRAGEIPPPGMVLETNGLMAALYAEKWGGISRCTEIVPDRPESLKEAMESNLDADIILLSGGTSVGKRDHAPEVVTSMGELLVHGVALSPGKPVALGVIGKVPVVCLPGYPVAGLVALYFFVRPGIRKLGSIPEVPGIVLRKRLAAKISSKIGYVNFIRVVFEGDRARPIMGAGAGVLSSVAKADGYVLVPENLEGYEEGQEVDVFLIE

SEQ ID NO: 8306 - protein, 457 aa, Triticum aestivum
AEADEKTESEEEENILSETTEKKGESDSEEAPDAEKEDPEYELDPFTKYDPQLPRVVRMANLCVVGGHSVNGVAEIHSEIVKQDVFNSFYEMWPTKFQNKTNGVTPRRWIRFCNPELSTIISKWIGSDDWILNTDKLAGLKKFADDEDLQSEWRTAKRNNKMKVVSLIRDKTGYVVSPDAMFDVQVKRIHEYKRQLLNILGIIYRYKKMKEMSAKDRIKSFVPRVCIFGGKAFATYVQAKRIVKFITDVAATVNYDPDIGDLLKVVFVPDYNVSVAETLIPASELSQHISTAGMEASGTSNMKFAMNGCILIGTLDGANVEIREEVGEENFFLFGAHAPEIAGLRQERAEGKFVPDPRFEEVKEYVRSGIFGTGNYDELMGSLEGNEGYGRADYFLVGKDFPSYIECQEKVDEAYRDQKLWTRMSILNTAGSPKFSSDRTIHEYAKDIWGISPVIMP

SEQ ID NO: 8307 - protein, 396 aa, Oceanobacillus iheyensis HTE831
MVYKNLKDEAIELHYKHKGKLEITGKMEINTEDDLSLVYTPGVADVCKQIADDPNKINTLTSRGNMVGIVTDGTAVLGLGNIGPKAAMPVMEGKALLFKKFANIDGFPICLDTTDVDEIVNIVKAMGPTFAGINLEDIAAPRCFEIEKRLKEELDIPVFHDDQHGTAIVVLAALTNALKVVNKQNRPIKIVINGAGAAGIAIAKLLYHAGLTNITLVSLEGVVAKGEDWLNPMQVEMAEVTNKDNVRGTLKDAITEADVFIGVSGPGALKKEHIQTMAKDPIIFALANPIPEIYPEEALEAGAAVVATGRSDYPNQVNNLLAFPGIFRGAIDAGARDITTEMKVAAAYGIADVLSDEEISKDKVIPNALDERAGERVAQAVMSSAIQQKKETSSVS

SEQ ID NO: 8308 - protein, 456 aa, Drachiella spectabilis
YVIKETDILALFRVSPQPGVDPVEASAAVAGESSTATWTVVWTDLLTACDLYRAKAYKVDPVPNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSIEAVNRSIAATGEVKGHYMNVTAATMEEMYERAEFAKQLGTVIVMIDLVIGYTAIQSMGIWARRNDMILHLHRAGNSTYSRQKIHGMNFRVICKWMRMAGVDHIHAGTVVGKLEGDPKMIKGFYDTLLQPYLDVNLPEGIFFKQDWAALRKVTPVASGGIHCGQMHQLLDYLGNDVVLQFGGGTIGHPDGIQAGATANRVALEAMVIARNEGRDYVKEGPQILRDAAKTCGPLQTALDLWKDITFNYTSTDTADFVETPTANV

SEQ ID NO: 8309 - protein, 356 aa, Ralstonia solanacearum
MTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 8310 - protein, 500 aa, Spinacia oleracea
MEKVKAAKKFIENHYRSQMKNIQERKERRWVLEKQLASSDVPEEEQMSLIKDLERKETEFMRLKRNRICVNDFELLTIIGRGAYGEVQLCREKKSENIYAMKKLKKSEMLSRGQVEHVRAERNLLAEVDSHCIVKLFYSFQDAEYLYLIMEYLPGGDMMTLLMREDILTEKVAKFYIAQSVLAIESIHKHNYIHRDIKPDNLLLDKNGHMKLSDFGLCKPLDCATLSTIKENESMDDVSKNSMDIDASLPDAGNGHSWRSAREQLQHWQRNRRKLAFSTVGTPDYIAPEVLLKKGYGMECDWWSLGAIMYEMLVGYPPFYSDDPITTCRKIVHWRHYLKFPDDAKLTFEARDLICRLLCDVEHRLGTGGAEQIKVHAWFKDVEWDRLYETDAAYKPQVNGELDTQNFMKFDEANPPTPSRSGSGPSRKMLTSKDLSFVGYTYKNFDAVKGLKHSFDRKGSTSPKRPSLDSMFNENGMDYTAKHAEEMDVQMLTADDCMSP

SEQ ID NO: 8311 - protein, 473 aa, GIBBERELLA ZEAE PH-1
MPTVRATRTRNENDENSGTTRLTRAQAAALKVDELSMPAKAALQTKKSTANGTAAANTRKRAALGDVSNVGKADGVAGKKAKGLVSKAAQPTGIEKKTARPTRPALASQTANSKPAQSGSGTINNKRKVLTDTKPKAPVKKTEPTSKEPELTEENERSETPEEAEVEKPEVSVEKPEVQDAPFKYPPGVNNLDEEDLEDPLMVAEYANEIFEYLRDLECKSIPNPQYMSHQDDLEWKTRGILVDWLIEVHTRFHLLPETLFLAINVIDRFLSEKVVQLDRFQLVGITAMFIASKYEEVLSPHVENFKRIADDGFSEAEILSAERFVLSTLNYDLSYPNPMNFLRRVSKADNYDIQSRTIGKYLMEISLLDHRFMAYRPSHVAAGAMYLARLMLDRGEWDATLSYYAGYTEDEVEPVVHLMVDYLARPVVHEAFDKKYAAKKFLRASLLARQWAKKNAVLFGITDIELGLDQIS

SEQ ID NO: 8312 - protein, 440 aa, Streptomyces tendae
MYELLKTIMIEELEVEAGQVSPDASREDAGLDSLATFELSLALSQRLGVTIADEDLFGLRTLADIAEFLEKRTAGLPGSPGTSGSPAADQAEGREHAGLTRLLGTGDGVHPGGPAPAHQLARNENPFQPPASVLDAITRAAAEANRYPDPACEALRAALARHYGLFPDRVAVGAGSITLLQALLTVTAGPGAAVAYSWPSFDGYEVLADLAGFRTVRVPLAEDGHDLDALAAAVDEHTRLVLLCNPNNPTGTASGEADLLRFLDAVPRTCLVVLDEAYCEYARDPGLGARLLTSWPNLIVARTFSKAYGLAGMRVGYLLAEPGLISRVHRMVMPLSVSDVAQAAAVASLAAEKELLGRVRETAAERDRVRAALLALGFDVPPSEANFLWLPLGARAEEFAAACASAGVAVRPYPGDGVRVTTGTAEDNDAFLAAAEMNRP

SEQ ID NO: 8313 - protein, 119 aa, Zea mays
GISWETKDKVHRANYFGSLTQASTIRIGSHNGEEIYAPFKSLVPMVNPNTIVFGGWDISNLNMADAMARAQVLDIHLQKQLRPYMESMQPLAGIFNPDFVAANQGARANNIIKGTKKEQ

SEQ ID NO: 8314 - protein, 255 aa, Pseudomonas putida KT2440
MRWSTPIDTNQPSSLSLSYNARHREFANRCAMQPYAIAPSILSADFARLGEDVDKVLAAGADIVHFDVMDNHYVPNLTIGPMVCTALRKYGVTAPIDVHLMVSPVDRIIGDFIEAGATYITFHPEATQHIDRSLQLIKDGGCKAGLVFNPATSLDALKYVMDKIDMVLLMSVNPGFGGQKFIPGTLDKLREARALIDASGRDIRLEIDGGVNVNNIREIAAAGADTFVAGSAIFNAPDYQEVIAKMRAELALARP

SEQ ID NO: 8315 - protein, 574 aa, Escherichia coli CFT073
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASEMLAQYSPLVLNGEGLVLPELKDIQKVSRAIAFAVGKMAQQQGVAVKTSAEALQQAIDDNFWHAEYRDYRRTSI

SEQ ID NO: 8316 - protein, 493 aa, Pseudomonas putida KT2440
MTLVRFQMCIDGQWRDAQSGKTFDSLNPATAQAWAQLPDADEADVELAVQAAQRAFDSKAWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPSTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHMGGKRADVEGDGWFYEPTLFECDSNAMTIMQEEVFGPVAAVIRFKTEEEALAMANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 8317 - protein, 357 aa, Nicotiana tabacum
MGGLEVEKTTIGWAARDPSGVLSPYTYTLRNTGPEDVEVKVLYCGLCHTDLHQVKNDLGMSNYPLVPGHEVVGEVVEVGPDVSKFKVGDTVGVGLLVGSCRNCGPCKRDIEQYCNKKIWNCNDVYTDGKPTQGGFAKSMVVDQKFVVKIPEGMAPEQAAPLLCAGITVYSPLNHFGFKQSGLRGGILGLGGVGHMGVKIAKAMGHHVTVISSSNKKRQEALEHLGADDYLVSSDTDKMQEASDSLDYIIDTVPVGHPLEPYLSLLKIDGKLILMGVINTPLQFISPMVMLGRKSITGSFIGSMKETEEMLDFCKEKGVTSQIEIVKMDYINTAMERLEKNDVRYRFVVDVIGSKLDQ

SEQ ID NO: 8318 - protein, 570 aa, Bacillus anthracis str. A2012
MSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 8319 - protein, 589 aa, Populus balsamifera subsp. trichocarpa X Populus deltoides
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLLGGSLADHTFLFLGAGEAGTGIAELIALEMSRRSKTPLEETRKKIWLTDSKGLIVSSRKESLQHFKKPWAHEHEPVKGLLEVVKAIKPIVLIGTSGVGKTFTKEVIEAMASFNEKPLILALSNPTSQSECTAQEAYTWTKGKAIFASGSPFDPVEYEGKVFVPGQSNNAYIFPGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 8320 - protein, 310 aa, Escherichia coli CFT073
MLDANKLQQAVDQAYTQFHSLNGGQNADYIPFLANVPGQLAAVAIVTSDGNVYSAGDSDYRFALESISKVCTLALALEDVGPQAVQDKVGADPTGLPFNSVIALELHGGKPLSPLVNAGAIATTSLINAENTEQRWQRILHIQQQLAGEQVALSDEVNQSEQTTNFHNRAIAWLLYSAGYLYCDAMEACDVYTRQCSTLINTIELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 8321 - protein, 471 aa, Onikusa pristoides
SGVIPYAKMGYWDPDYAVKETDVLALFRVTPQPGVDAVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGVDVVLQFGGGTIGHPDGIQAGATANRVALEAIVIARNEGRDYVAEGPQILRDAAKTCGPLQTALDLWKDISFNYTSTDTADFVETPTANV

SEQ ID NO: 8322 - protein, 390 aa, Hordeum vulgare subsp. vulgare
MQDTSSTQHKSLPNNIIEMDMVTSMPLEANSNGQILQAEAELFCHSFGYLKSMALQSVVKLRIPDVLHRYGGAASLPELLSTVPIHPNKLPYLPRLMKMLAAAGIFTAEDVPATVGDGEPTTLYHLNAVSRLLVDDASVNGGASMSPCVLLGTVPLFLGASLKLHEWLQSEEQATTETPFMLAHGGTLYGIGGRDSEFNTVFNKAMGASSEFVAALAVRECRDVFAGIKSLVDVAGGNGTTARTIAEAFPYVKCSVLDLPQVIQGISSHGTVEFVAGDMMEFVPPAEAVLLKYVLHNWSDQDCVKILTRCREAISHGEKAGKVIIIDTVVGSPSQQILESQVTMDLSMMMLFNGKVREEQNWHKIFLEAGFSHYKIHNVLGMRSLIEVQP

SEQ ID NO: 8323 - protein, 349 aa, Yarrowia lipolytica
MTTIPKTQKAVIFETSGGPLMYKDVPVPVPADDEILVNVKFSGVCHTDLHAWKGDWPLDTKLPLIGGHEGAGVVVAKGKNVTTFEIGDYAGIKWINKACYTCEFCQVSAEPNCPKATMSGYTHDGSFQQYATANAVQAAHIPKNCDLAQIAPILCAGITVYKALKTAGLKAGEWAAVTGAGGGLGSLAVQYAKAMGYRVLAIDTGADKEKMCKELGAEVFIDFAKSKDLVKDVQDATKGGPHAVINVSVSEFAVGQSVEYVRTLGTVVLVGLPAGAVCKSPIFQQVARSIQIKGSYVGNRADSQEAIEFFARGLVKSPIIIVGLSQLESVYKLMEEGKIAGRYVLDTYK

SEQ ID NO: 8324 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 8325 - protein, 308 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDN

SEQ ID NO: 8326 - protein, 636 aa, Pseudomonas putida KT2440
MVQASSHAESGHEGKQGASRSVGLLVAAVGVVYGDIGTSPLYTLKEVFTGGYGVSVNHDGVLGILSLILWSLLWVVSFKYVMFILRADNQGEGGTMALTALARRATAAYPRLRTLMVICGLIGASLFYGDSMITPAVSVLSAVEGVGLAFDGIDHWVVPISLVVLVALFLVQRHGTEKIGKLFGPIMVTWFLALGALGVHGISQSPEVLKAFNPAWAVNFFVVHPGIGVAILGAVVLALTGAEALYADMGHFGRKPIARAWFILVLPALVLNYFGQGALLLQNPEAARNPFYLLAPGWALLPLVGLATMATVIASQAVISGAFSLTRQAIQLGYIPRMQIQHTSSDEQGQIYIGAVNWTLMVGVVLLVIGFESSGALAAAYGVAVTGTMLITTVLVSAVMLLLWKWPPLLAVPILVGFLLVDGLFFAANVPKIAQGGAFPVLAGGVLYLLMSTWKRGKQILVERIDEGALPLPLFISSIRIQPPHRVEGTAVFLTARSDAVPHALLHNMLHNQVLHSQVVLLTVVSEDRPRVPEHERFEVEAYGDGFFRVLLHFGFMDEPDVPAALKLCHLDGLDFTPMRTTYFLSRETVIASRLEGMSRWRGNLFAFLLKNANGNLRFFNLPLNRVIELGTQVEI

SEQ ID NO: 8327 - protein, 415 aa, Oryza sativa
  unsure (1)..(415): unsure at all Xaa locations
MAGGEPPAPATEAEEGRRAALLREITEEGGFAFVASAEKAACGDLRAAEAAREMAWEQLHSGPWSEVGAAWRDAYALACLHVARLRRLGAAAADRRAALRALDMGLIMGGNLLRADLEAAIARIVADXAAAATRRPSTRRPGGGGKGSRGIETSPMYFFQALNILPAKSLSCKKVERRSCISLEEFICDYFLRESPVIISGSIDHWPARTKWKDIQYLKKIAGDRTVPVEVGKNYVCSEWKQELITFSQFLERMWSAGCPSNLTYLAQHPLFEQIKELHEDIMVPDYCYAGGGELQSLNAWFGPHGTVTPLHHDPHHNILAQVLGRKYIRLYPASISEDLYPHTETMLSNTSQVDLDNVDLKEFPRVENLDFLDCILEEGDLLYIPPKWWHYVRSLSISFSVSFWWRSTVVPSKG

SEQ ID NO: 8328 - protein, 479 aa, Pseudomonas putida KT2440
MSKILTTASGAPVADNQNSRSAGPRGPLLLDDFHLIEKLAHFNRENIPERRVHAKGSGAYGTFTVTHDITGYTSAKLFEEVGKQTETFLRFSTVGGERGSADTERDPRGFAVKFYTEEGNWDIVGNNTPVFFIRDPLKFPDFIHTQKRHPQSNLKNAQMMWDFWSHSPEALHQVTILFSDRGIPDGYRHMHGFGSHTYSLINAKGERTWVKWHFKTQQGIKNLTPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYSDAPKQSPRHAEPALAMNGSADRYDHREDTDYFSHAGALFRLMNDEQKALLISNIAGTMAGVSEDVIQRQLQYFFKADPAYGEGIAKALGINLA

SEQ ID NO: 8329 - protein, 519 aa, Debaryomyces hansenii
MFDVDTVHNFFTSWYGILLAVLIGYHVFDYIRIQIVMKKLGCVSPPVELDGFFGFKLLYTSLKHKKEGTLVNFIKERFETVGKDTFSFRIAGTPVISTKNPENIKALLATQFSDFALGTRHAQFKPLLGDGIFTLDGSGWKHSRAMLRPQFAREQVAHVKSLEPHIQMLAKHVRRAKGGAFDVQSLFFRLTVDSATEFLFGESVESLQDESIGMAKDAVDFDGKAGFAEAFNTAQVYLSIRSLAQKAYFLVNNKEFRSSNEKVHKFADYYVQKALNSSPEELEKHSQDGYIFLYELVKQTRDPHVLRDQLLNILLAGRDTTAGLLSFTFYELARNPQVWLKLKEEIYEKFGKGDDARLEDITFESLKKCEYLKALLNEVLRLYPSVPQNFRVAQKDTSLPRGGGPNRDQPIFIAKGQTVTYTVYAMHRDEQFYGKDSEVFRPERWFEPETRKLGWAFLPFNGGPRICLGQQFALTEASYVIARLAQLFPNLASHDDEYPPRKASHLTMCHQSEVKISLA

SEQ ID NO: 8330 - protein, 557 aa, Bacteroides thetaiotaomicron VPI-5482
MKQMLQICCKNNNIYKEFPIGSSLLDIYYGFNLNFPYQVVSAKVNNRSEGLNFKVYNNKDIEFLDVRDSSGMRTYVRSLCFVLFKAVSELFPEGKLFVEHPVSKGYFCNLRIGRPITLEDVTRIKQRMQEIIAENISYHRIECHTAEAVRVFSERGMNDKVRLLETSGSLYTYYYTLGDTVDYYYGNLLPSTGYIKLFDIVKYYDGLLLRIPNKENPDVLEEVVKQEKMLDVFKEYLNWSYIMGLNNAGDFNLACEEGHATDLINVAEALQEKKIAQIADTIFHRGENGDRVKLILISGPSSSGKTTFSKRLSIQLMTNGLKPFPISLDNYFVDREETPLDENGNYDYESLYALDLELFNQQLQALLRGEEVELPRFNFSLGKKEYKGDKLKIEDNTILILEGIHALNPELTPHIPDEKKFKIYVSALTTISLDDHNWIPTTDNRLLRRIIRDFNYRGYSARETISRWPSVRAGEDKWIFPYQENADVMFNSALLFEFAVLRLHAEPILMGVPRNCPEYCEAYRLLKFIKYFVPVQDKEIPPTSLLREFLGGSSFKY

SEQ ID NO: 8331 - protein, 398 aa, Oryza sativa
MDAGAQPPDTEMAEAGGGQQPPAAAAAAGAGAGAGMMENIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQRNSFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVHPLAIDLVEKMLTFDPRQRITVEGALAHPYLASLHDISDEPVCSSPFSFDFEQHALSEEQMKDLIYQEGLAFNPDYQ

SEQ ID NO: 8332 - protein, 330 aa, Oryza sativa
MSFGVVDMDEEGGAAAAADEIRRLPAEVNWEMLDKSRFFVLGAALFSGVSAALYPAVVVKTHLQVAPPPQAATATAAAILRRDGLRGFYRGFGASLAGTVPARALYMAALEATKSSVGSAAVRLGVSEPAATAAASAAGGVSAAIAAQVVWTPVDVISQRLMVQTSSTCRYRGGVDAFKKILLADGVRGLYRGFGLSIVTYAPSNAVWWASYAMAQRFIWRVVGAERSESYPSLMAVQGASAALAGGASALVTMPLDTVKTRIQVMETDGAAAARPTLKSTVRGLLKEGGWAACYRGLGPRWGSMSLSAATMVTTYEFLKRLSAKEGSLD

SEQ ID NO: 8333 - protein, 873 aa, Oryza sativa
MRRHPLLPLLAAVLVGAAVRAGKIATEVVVPDFVASYLLFIDTYGVFLQSGGGGAFQAVVYNPAGQQDRYYLAVVHAPSKTCVWVANRDAPITDRAAPLRLTARGISAEDPNGTVVWSTPAFASPVAALRLDESGNLALLDGRNRTLWQSFDRPTDVLVSPQRLPVGGFLASAVSDSDYTVGGYRLDVTAADAALTWNGSLYWLLSIDVKSTRDRDGAVASMAVNGTGLYLLAADDTVLIQLPLPDAKLRIVKLGVEGKLVITSYASANATSPSPTDAGFVAPNSGCDLPLSCGALGFCAPNGNASSCTCPPLFASSHDGGCTPADGSKAMTVASCGGADMVGSNGSSCQALCSGNCSCLGYFYDESSLSCFLVQHQIGSLVNANSRRGDMVGFIKVQSSQSPGSPSGSSSNNSTLIAILLPTIVAFVLVVVVGAVIVVSWRKQERRAGRRASRSRDVQLRRHRSPASDSAHLVYGNDDDGNDIVIPGLPTRFTHEEIEDMTNSFRIKIGAGGFGAVYKGELPDSSAVAVKKIEGVGMQGKREFCTEIAVIGNIRHVNLVRLRGFCVEGQRRLLVYEYMNRGSLDRTLFRPAAGQPLEWKERMEVAIGAARGLAYLHFGCDQRIIHCDVKPENILLADGGQVKIADFGLAKLLTPEQSGLFTTMRGTRGYLAPEWLTNTAITDRTDVYSFGMVLLELVRGRKNRSEHVSDGAGAATGDDSNSSNGTTGSSSRGARSDYFPLMALEGHEAGQYAALADPRLEGKVVAGEVERVVKVGLCCLHEDPQLRPSMAMVAGMLEGTMELWEPRVQSLGFLRLYGRGFAGPADGSGGSGGGIKQAMAGSNGDHTRSGTTTVTTMSGWPSYMSSSQLSGPR

SEQ ID NO: 8334 - protein, 523 aa, Glycine max
MTSHIDDNLWIIALTSKCTQENLAWVLLIMGSLWLTMTFYYWSHPGGPAWGKYYTYSPPLSIIPGPKGFPLIGSMGLMTSLAHHRIAAAAATCRAKRLMAFSLGDTRVIVTCHPDVAKEILNSSVFADRPVKESAYSLMFNRAIGFASYGVYWRSLRRIASNHLFCPRQIKASELQRSQIAAQMVHILNNKRHRSLRVRQVLKKASLSNMMCSVFGQEYKLHDPNSGMEDLGILVDQGYDLLGLFNWADHLPFLAHFDAQNIRFRCSNLVPMVNRFVGTIIAEHRASKTETNRDFVDVLLSLPEPDQLSDSDMIAVLWEMIFRGTDTVAVLIEWILARMALHPHVQSKVQEELDAVVGKARAVAEDDVAVMTYLPAVVKEVLRLHPPGPLLSWARLSINDTTIDGYHVPAGTTAMVNTWAICRDPHVWKDPLEFMPERFVTAGGDAEFSILGSDPRLAPFGSGRRACPGKTLGWATVNFWVASLLHEFEWVPSDEKGVDLTEVLKLSSEMANPLTVKVRPRRG

SEQ ID NO: 8335 - protein, 463 aa, Chondracanthus acicularis
MGYWDPDYVVKDTDVLALFRVSPQPGVDPVEASAAVAGESSTATWTVVWTDLLTACDLYRAKAYKVDNVPNTTDQYFAYIAYDIDLFEEGSIANLTASIIGNVFGFKAVKALRLEDMRLPVAYLKTFQGPATGIISERERMDKFGRPFLGATVKPKLGLAGKNYGRVVYEGLKGGLDFLKDDENINSQPFMRWKERYLYSMEGVNRAIAAAGETKGHYLNVTAATMEEMYERAEFAKELGSIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMVIARNEGRVYVSEGPQILQDAAKTCGPLQTALDLWKDITFNYTSTDTADFVETPTANV

SEQ ID NO: 8336 - protein, 130 aa, Zea mays; identical to SEQ ID NO: 3907

SEQ ID NO: 8337 - protein, 252 aa, Streptococcus pyogenes M1 GAS
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 8338 - protein, 596 aa, Zea mays
MTSTAVGGEPAAGHGYWRWSKADFFPEPSFQSWRAYGGALLSTGPRLRDRVTSRSSEAVEAGTLLAQSENPLRRCLSWVDLAFLGFGSVVGSGVFVLTGQEARFDAGPAIPLAYAAAGFSALLSSFCYAELAGEIPSAGGSFSYLRVELGDLAAFIAAGNILLEAVVGAAGLGRSWTSYLAALIGRDSDALRIHVPALADGFNLLDPIAVVVLCATSALAVSGARLTSTVNSVASAVGIAIIAFVLAAGFSHFEPANLAPSFFPFGAAGVFRAAAVVYWSYTGFDMVATMAEETKNPGRDVPLGLISSMSAITLVYCAMSLALVGMQRYSDIDANAAYSVAFAAAGMKWARYVVALGALKGMTSGLLVGALGQARYTTQIARTHMIPPYFALVHPRTGTPIYATIAVTLGAACVALFSSLDVLASVSSISTLFIFALVAVALLVRRYYVAGTTSPAQARTFVGFLALIVLSSIGLSVYYNSGYAARWPGYVAFGALWAAGTAGLALFAEQQRAPRVYGAPLMPWLPAMSVATNLFLMGSLGSLAYMRFGICTAAMLVYYVLFSVHATYDMVHSQGQTTSAADAATDGVEQRKIMPV

SEQ ID NO: 8339 - protein, 124 aa, Rickettsia sibirica
MTKTKQEIYNKRPTSPHLTIYKPQISSTLSILYRMTGVALFFAVSILVWWLILSQYDNNYLQLAECCIIKICLVAVSYAWFYHLCNGIRHLFWDIGYGFSIKLVNITGWCVVVGSVLLTVLLWV

SEQ ID NO: 8340 - protein, 307 aa, Helianthus annuus
MANFPVINMENLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHESS

SEQ ID NO: 8341 - protein, 328 aa, Zea mays; identical to SEQ ID NO: 5139

SEQ ID NO: 8342 - protein, 415 aa, Methanopyrus kandleri AV19
MSKRKYRGFVYTDDLAKPEEFIRFLRRFLSPPEPETVEVGPELSGRVLAEDVRAERPSPPFTRSAMDGYAVRSEDAEPGARLKVVGESRIGEGTDVKVGPGEAVYVDTGAPVPEGADAVIPVEFVERDGDEIIVEEGVDPGDNLDPAGCYVEEGEVLYRSGHLVEPVDVGVMLEHGVEEVDVHRPLRVSIVVTGNELVHRPSELESETQVVDCIGPVLTAELENMGCVEVVGTSLVKDDPGEIRETVEDYADRSDVVLITGGSSVGERDHVKDILDDTFDAFIHGIRARPGRPFGIAAREGTVAFTLPGWPTSCYSTFRVWVVPSLLVLAGADPLVVGFETEATGIKSKREVGVIARVRLTSDGAEGLSRDRSSHFALFRETDGFALVPPGGSERALILPLRGFLNLFDEVERKF

SEQ ID NO: 8343 - protein, 256 aa, Triticum aestivum
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASS

SEQ ID NO: 8344 - protein, 483 aa, Oryza sativa
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLVAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 8345 - protein, 226 aa, Saruma henryi
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 8346 - protein, 549 aa, Oryza sativa
MSLAAESPSPSSPSSSSGSDDFAALLDAELELTSAADSASAGDPSAATDDDDEGGDEEEEDVVVVVEQEDAIVEQSRGWRWLLIFCAVRAFDIRWVNIDSLGGALMESQLPSVKTSFISMSRWYTVAGSSKDVKIDECPPHPGFFGGLCYRCGKRQDEEDVPGVAFGYIHKGLRLGTTEIDRLRGADLKNLLRERKLVLILDLDHTLINSTKLFDLSAAENELGIQSAAKEVVPDRSLFTLETMQMLTKLRPFVRRFLKEASDMFEMYIYTMGDKAYAIEIAKLLDPDNVYFGSKVISNSDCTQRHQKGLDVVLGDESVAVILDDTEYVWQKHKENLILMERYHYFASSCRQFGFGARSLSETMQDERENDGALATILDVLERIHTIFFDPVIKRVRQEVLQGCKLVFTRVFPLHQRQQDQMIWKMAEQLGAVCCTDVDSTVTHVVALDLGTEKARWAVSNKKFLVHPRWIEAANFRWQRQQEEDFPVARPKEKGKENAADAPISKENGDKNAADAANAKKGNENVADAGSTKEGSKENADDAANSEEE

SEQ ID NO: 8347 - protein, 322 aa, Listeria ivanovii subsp. londoniensis
MYKLRSRQFLVVLLLCLVCYIITFPSSGKAHSIKSNYRTVQNTITTKKWMSALPDNTKLTSLTIPGTHDTMSYKGNISWTLTKALAQTQKMSLFQQLEAGIRYIDIRAKDDLQIYHGPIYLDASLKGVLETTINFLKENPKETIIMRLKDENNNKNDKFDYRIQPLINPYKAFFYTTPKSDPSDKFPTLKELRGKILLLSENGTNKPLTINQSNFGMKFAAENQVIQDDFNGPSIKTKYNEIVQTAHQAFKQASKENKLYLNHVSATSLTCTPYHYAATLNAKVSQHVTKLTTVGVRGLGVFIMDFPPKQTIKNVIKNNKFN

SEQ ID NO: 8348 - protein, 202 aa, Zea mays
MHQFLIKLQKRRALEESEEGLKATLNVNVFGTITLTRLLAPYMLDREMGHFVVMSSAAGKVPAPGQAIYSASKHALNGYFASLRSELCTKGIKVTVICPGPIETLQSSAAASSSQTHSAEQKREKRVSVERCVELTIVAATHGLKEAWISYQPVLTVMYLVQYMPTIGYWLMDKVGAKRLDAAAKKGNTYSWSLIFSSKKSA

SEQ ID NO: 8349 - protein, 108 aa, Zea mays
TSEIFMGGKNTIVLHNTCEDSLLAAPIILDLVLLAELSTRIQLKPEGTDKFHSFHPVATILSYLTKAPLVPPGTPVVNALAKQRAMLENIMRACVGLAPENNMILESK

SEQ ID NO: 8350 - protein, 314 aa, Lyngbya sp. PCC 7419
NGFGRIGRLVMRSAIKNPEIEFVAINDLVPAENLAYLFKYDSTHGKLESQVEAKDDHIIVDGHSIRCTSVRNPDQLPWKEMGVDYVVESTGLFTTYDGASNHLSAGAKRVIISAPTKDPDKVKTLLMGVNHEEFNPQDHLIVSNASCTTNCLAPVAKVIQDNFGLAEGLMTTVHSMTATQPTVDGPSKKDFRGGRGAAQDIIPASTGAAKAVTLVLPELKGKLTGMAFRVPTPDVSVVDLTFKTEKSTSYKEICAAMKAASEGPMKGVLGYTEDPVVSTDFITDSHSSIFDADAGMELNSNFFKVVSWYDNEWG

SEQ ID NO: 8351 - protein, 1089 aa, GIBBERELLA ZEAE PH-1
MANQETHYGFDEGGDDDQSIVSTRGLEAFSRKVTTTATHLIGPNAEATAHHYQAAMAEVHKQMKRPTVQRSMFAMARTTPTDLMRSRLSTHEIQHRALTFLPDDLLANIPEHENPYSLFQGFQASFPELTDEGKKFQRRVSRGRKMLEDSEGTPGSPKKLTQLKKEKAAMMHEFGLLGTRKSMASYEIREIDNKIANLHGMRRIILDRLAGLEQDEAMLEHDISEMEIRVDEAQVLVDEAEELERNTRTQDEQDLVGDADDHDPEFMSQSVYEKIPASEASSTPRKTKKVHRKKSMPILHEHFEPGTAIRELRAHKDTITAIDFDAPFGTMVTAALDDTVRVWDLNAGRCMGYMEGHTASVRALQVEDNILATGSVDATIRLWDLSKAHYDPHGGLGKDDDEDAIAFGTDNHLEPPPGSMADCPLYTLESHVDEITALHFRGDVMVSGSADKTIRHWDLEKGRCVQTLDVMWAAAASMTTTDSTWRPTGRSQSTSADFVGALQVFETALACGTADGMVRLWDLRSGQVHRSLVGHTGAVTCLQFDDVHLVTGSVDRSIRIWDLRTGSIYDAYAYDNPVTDMMFDARRIVSAAGEDVVKVYDKVEGRQWECGAGITAAEEGKTPAIVERKAHELFEHSDTKHDENDTDSTASAMIQLLARQAQAIVTLHENLSHNDNKCKVDEELLKKRIADLISISLSKFYAYRYDLLPLVWRQIYTDACVLESFQILLRPLSAGKNPSEQALDATVEKLDRALITAGGGGQPEWLEKTLSLLEEAWIAGEQKERPFKSQRHDKSSQREFSSREPYGRPTLLPKRECPRYSGWTMLQFEDYMNSNEGEPRPIVFTDLIRDWPALADRPWRSPEYLLSKTFGGRRLVPVELGRSYVDDGWGQDLIPFHEFLSRYVENKSSISDKTGYLAQHNLFQQIPTLRNDIYIPDFCWVDVPPHPTTPSLNQPPVDVPQLNAWFGPARTITPLHTDGYHNLLCQVVGTKYIRLYPPRATPAMRPRAPEHGVNMSNTSELDVGVLEGWDDRPEDMEEEDLELMRRELEGTEYWECILEPGDTLVIPIGWWHYVRSLSVSFSVSFWWNS

SEQ ID NO: 8352 - protein, 476 aa, Tropheryma whipplei str. Twist
MRADIGVYGLAVMGSNLARNFAGKGIRVAIHNRSSDRSNSLAQQHSECNFIVAKDDKDFIDSLSSPRTVLLMVKAGSIVDEVIARLSTFMQPGDVIIDGGNSLYTDTIRREEELKARGLHFIGLGVSGGEVGALEGPSLMPGGSDYAYSIVGPMLEKIAARANGEPCVAHIGHNGAGHFVKMVHNGIEYADMQIIAESYDLLRRGLGLSPTRISDIFREWNSGELESYLVGVTADILSHRDKRTGKPFVDIVLDQAGAKGTGAWTAQNALDLGVPAGSVSEAVFARSLSSDEQRCQVQQKLSRSQASSHEAPLKEAEFIDAVRNALYLAKILAYSQGFRIISVAAAKHDWGIDLSACARIWRAGCIIRAVFLDKVAHEYSKNPDLTSLMCSPGFSDELVGRLRFLREVVASAARLAIPAPVFSSLLSYIDALASDRLPACLIQAQRDDFGAHTYRRVDVPGIFHTLWSSDLSEVPA

SEQ ID NO: 8353 - protein, 382 aa, Glycine max
MVGETAATGKSVGLGLGCDPVVGSLACSKKREYRVTNRLQEGKRPLYAVIFNFIDSRYFNVFATVGGNRVTVYQCLEGGVIAVLQSYVDEDKDESFYTVSWACNVDGTPFVVAGGINGVMRVIDVGSEKIHKSFVGHGDSVNEIRTQTLKPSLVISASKDESVRLWNVHTGICILIFAGAGGHRNEVLSVDFHPSDIYRIASCGMDNTVKIWSMKEFWTYVEKSFTWTDLPSKFPTKYVQFPVYNASVHLNYVDCNRWLGDFILSKSVDNEIILWEPKVKEQTPGEGVVDILQKYPVPECDIWFIKFSCDFHFNLAAVGNREGKIFVWELQSSPPVLVARLSHPQSKSPIRQTATSFDGSTILSCCEDGTIWRWDDVTNSPD

SEQ ID NO: 8354 - protein, 473 aa, Halurus flosculosus
YESGVIPYAKMGYWDPNYAVKDTDILSLFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQTMAIWSRKNDMILHLHRAGNSTYSRQKIHGMNFRVICKWMRMAGVDHIHAGTVVGKLEGDPLMIRGFYNTLLHSHLDINLPQGIFFQQDWASLRKVTPVASGGIHCGQMHQLVDYLGNDVVLQFGGGTIGHPDGIQAGATANRVALEAMIIARNEGIDYVTEGPQILRDAAKTCGPLQTALDLWKDITFNYTSTDTADFVETPTANV

SEQ ID NO: 8355 - protein, 355 aa, Selenomonas ruminantium
MAYKITVIPGDGIGQEITDSAVEVLKAADKKFNLGLEFDYHDAGGTAYDKFGTPLPQETIDACKAADGVLFGAVGGDKWDKVDPAKRPEKAILGLRKALGLYANLRPVKVADALVEYSPLKPELVKGVDLVIVRELIGGIYFGEKCESEQHNGAERAWDLENYSVPEVERIANLAFETAKLRRGKVTSVDKSNVLATSRLWRRTVAKVAENYPEVECNNLYVDNCAMQIAVNPTQFDVIVTGNLFGDILSDEAAVVGGSIGMLPSASIGECTSLYEPIHGSAPDIAGQGIANPIGTILSAAMLLRYSLHEEAAADAIEAAVDKALGEGYRTPDLWKEGFTKVNTSEITKIISERV

SEQ ID NO: 8356 - protein, 242 aa, Neisseria meningitidis MC58
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPHTLEKIRRVRAMLDRYEAQSGRHIAIEVDGGIKTDNIAAVARAGADTFVAGSAIFGKPDYKAVIDAMRAELEKSGRLNLAPMIEIEMPSEN

SEQ ID NO: 8357 - protein, 126 aa, Actinidia deliciosa
  unsure (1)..(126): unsure at all Xaa locations
IENKINRQVTFSKRRSGLLKKANXISVLCDAEVALIVFSHRGKLFEYSTDACMEKILERYERYSYAERELVNDPETPFLNVQKNWSLECTRLGEKIELLQRNIGHYMGQHLDSLSLKDLQHFEQQL

SEQ ID NO: 8358 - protein, 309 aa, Pseudomonas syringae pv. tomato str. DC3000
MTSKLDQLKKFTTVVADTGDFGAIKSLKPQDATTNPSLLLKAASSESNDQMLADAFSGAKGDIGLACDRFAVAIGQEILKVVPGRVSTEVDARLSFDTDALIERSERIIGLYDTAGISRDRVLIKLAATWEGIRAAEKLEKDGIQTNLTLLFSFAQAVACAEAGVFLISPFVGRIYDWYKKSSGTDYVGADDPGVQSVTRIYNYYKANDFKTVVMGASFRNLNQIEQLAGCDRLTISTELLKQLAEDTGTLEQKLAPGNAGEARQSLTESQFRWASNEDAMATEKLAEGIRQFARDQEKLEALLSAKKS

SEQ ID NO: 8359 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIAMATGDKKDCLCFIEVIVHKDDTSKELLEWGSRVSAANSRPPNPQ

SEQ ID NO: 8360 - protein, 132 aa, Lotus japonicus
ALYQWAFAIAAAGITSGSIAERTQFVAYLIYSSFLTGLVYPIVAHWFWSSDGWGSPARTENLLFGSGVIDFAGSGVVHLVGAVAGFWGAFIEGPRMGRFDHAGKPVPLRGHSGTLVVLGTFLLWFGWYGFNP

SEQ ID NO: 8361 - protein, 348 aa, Chloroflexus aurantiacus
MTSIQNDINQEHIMAVRVGINGFGRIGRLALRAAWAWPELDIVHINEVGGDAATAAHLLSFDSTQGRWSVEVHGEGNQLLIDDKTVGYSQIRDPGAVPWADAGVDIVLEATGKFRTAEQLAAYFSAGVKKVIVAAPVKGEALNVVMGVNDHWYEPDRHHLLTAASCTTNCLAPIVKVIHEGIGIRHGMITTIHSSTNTQTVHDRPHKDLRRARAASLSLIPTTTGSATAIGLIFPELQGKLDGQAVRVPLLNASLTDCVFEVRRPTTVAEVNGLLQAAAEGALKGILAYETRPLVSIDFLGNPHSAIVDSLCTMVTNETQVKIYAWYDNEWGYANRYVELARKVALLL

SEQ ID NO: 8362 - protein, 500 aa, Azotobacter vinelandii
MAEFWTPRTTTRARDMNDKTVAPQQHDISYVLRICAVAALGGLLFGYDTAVISGAVEALQQYFSLSPAETGWAVSNVVVGCIVGALGAGWVAGRLGRKKALVLSAILFTVSAIGAAVVDSFVWFVIYRIVGGLAVGIASTVSPMYMSEVSPKDIRGRALGMQSFAIVGGQVVVFYVNYLIAKGAADTWLVEYGWRWMLGSEVVPCILFCLFVFSIPESPRWQAMVGQDERALRTLRRISNDAHAHHLLNEIKHSLHQDSQGRTQKPNLREAGLALILFVGCMLAMLQQVTGVNVMMYYAPMVLKGVTGSTESALFQTIWIGVMQLVGTIIGTWLIDRVGRLPLMRVGTVGIVASLLLTSYALYAQESGYLALIGMLLFMVLFAISWGVGTWVLISEIFPNHMRSMGMSMAVCSMWIANFLVTQSFPMLNEHPVLIERFHGAFPMWVFAGCCVFCYWFVARFVPETRGVSLERMEEVMLAKLKRQPLADEEESAALRSSRA

SEQ ID NO: 8363 - protein, 238 aa, Oryza sativa (indica cultivar-group)
ENSTNRQVTFAKRRNGLLKKAYELSVLCDAEVALIVFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEPMNSACMNTYMPPWLP

SEQ ID NO: 8364 - protein, 526 aa, Oryza sativa (japonica cultivar-group)
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLDTEIQEDADRAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTNFLGMLMTLLVPESKGMSLEEVSKENVADDEEATA

SEQ ID NO: 8365 - protein, 294 aa, Medicago sativa
MEQYEKVEKIGEGTYGVVYKARDRATNETIALKKIRLEQEDEGVPSTAIREISLLKEMQHRNIVRLQDVVHSEKRLYLVFEYLDLDLKKFMDSSPEFAKDQRQIKMFLYQILCGIAYCHSHRVLHRDLKPQNLLIDRSSNAVKLADFGLARAFGIPVRTFTHEVVTLWYRAPEILLGSRHYSTPVDVWSVGCIFAEMINQRPLFPGDSEIDELFKIFRITGTPNEETWPGVTSLPDFKSAFPKWPAKDLATQVPNLEPAGLDLLSSTCRLDPTRRITARGALEHEYFKDIKFVP

SEQ ID NO: 8366 - protein, 594 aa, Schizosaccharomyces pombe
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFLC

SEQ ID NO: 8367 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 8368 - protein, 536 aa, Phanerochaete chrysosporium
MGLTQAQRLVLGQLARLVAPALAVCVLLAAARRTQLVRAPVWADALIALIAIPLFHVGRAHWRVDVLQLVDEAYRRGFLSDYFYEKFGELGHTYNFYVLWDMDYCTEDAAVIKAVLATDFNNWVKGERFDSYMHSVLGTGVFNADGELWKFHRSMTRPFFARERITDFETFNRHAEEAILKMKERLREGFAVDFADLISRFTLDAATEFLFGACTTSPRRSARRRTQSRIARASRTDTPMRTVDRYLTPIIERALAMSRAAKQAPQGEKEEVADGETLLDHLARYTTDPTILHDEILNIMIAGRDTTGGTLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEVRMTAGGMWVKMREAQAMGQVA

SEQ ID NO: 8369 - protein, 227 aa, Paulownia kawakamii
MAREKIQIKKIDNATARQVTFSKRRRGIFKKAEELSVLCDADVGLIIFSSTGKLFEYASSSMKEILGRHNLHSKNLDKLEQPSLELQLVEDSNYSRLSKEVAERSHQLRRMRGEELQGLSIEKLQHLKKSLESGLSRVIEKKGEKIMKGDQSTSRKGKQLMEENERLRQQVADISNDCKNNAASDSENIVYDEGQSSESVNACNSVGPPQDYDSSDTSLKLGLPYSG

SEQ ID NO: 8370 - protein, 217 aa, Glycine max
  unsure (1)..(217): unsure at all Xaa locations
MDFLVGPTFTIDVASSPPPYDADLPGVATAADRPYGLFSGHSSDSESSIGTPDDSLDDENDVVSSKRNQSDEDEDKEEEEEEEVHSKLKGLASLDSLEDSLPINXCRRGLSNHLMGKSKSFTDLSQVNTLNTVKELQKQENPFNKRRRVQIATKLTRKSSFYAWSNPKSMPLLPVHEDEDNFLEEEEKPKKVSPSSSSSYSSEENKQDHVLVPKSYV

SEQ ID NO: 8371 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 8372 - protein, 173 aa, Triticum aestivum
KSPLSSSPLLSILPSLPASLLGAPPASCSLRSPRARARPMASGDSKPRSEEEWRAVLSPEQFRILRLKGTELPGTGEYNKFYGDGAYNCVGCGTPLYKSTTKFDSGCGWPAFFEGLTGAIHRTPDPDGRRVEITCAACGGHLGHVFKGEGFKTPTDERHCVNSVSIKFTPASS

SEQ ID NO: 8373 - protein, 176 aa, Oryza sativa
MAYQRVFQLGLRRAAGPSLRVQPAGRMVHRILAATEHASQSEAAEILAKQGVNRPVSPHLAIYKPQITWYALPLNRITGITLSCSLYLFGIAYLIAPYTGWHLETQSMVATVAAWPAAVKAGLKAFYAFPFFFHSFNGLRHLAWDVGIGFKNQQVIRTGWTACGLTVAFSLYYTPR

SEQ ID NO: 8374 - protein, 389 aa, Shigella sonnei
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKAIKFLREEMGVKKIRFPEHXXXXXXXXXXXXXXXXXXXXXXXXXXXXXXXXXXXXXXXXXXXXXXXXXXXXXXXXXXXXXXXXXDGGPWMKVKNPITGKEMVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLR

SEQ ID NO: 8375 - protein, 152 aa, Picea glauca
MAMDPSLITVQHLLGVPDDLEKLLNAPTHSYMRDTKAMASTPVDVKEYPNSYVFIIDMPGLKSNDIKVQVEDENVLNISGERKRNEKDEEGEVKYIRMERRVGKFMRKFTLPADCNLEAISAACQDGVLTVTVPKLPPPEPKKPKTIEVKIG

SEQ ID NO: 8376 - protein, 93 aa, Glycine max
  unsure (1)..(93): unsure at all Xaa locations
MFFSMISPPAXTTVNRAGSGMFAPFTGLKSMAGFPTRKTNNDITSIASNCXRVQFMQVLPPFGKKKFXLLSYLPDLYDAQLSYDVLIPSYLCM

SEQ ID NO: 8377 - protein, 402 aa, Pseudomonas syringae pv. syringae B728a
MADQGSPRRFARIDRLPPYVFNITAELKMAARRRGEDIIDLSMGNPDGATPPHIVDKLITVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFDELEKAIRGSIPKPKMMILGFPSNPTAQCVELDFFERVVALAKQYDVLVVHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPQAYAHLGSLEFAKKLLAEAKVCVSPGIGFGEYGDDHVRFALIENQDRIRQAVRGIRSMFRADDKLKS

SEQ ID NO: 8378 - protein, 498 aa, Nicotiana tabacum
MGKVVVGAAVVCTAAVCAAAVLLMRHKMKNSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATALVKFVATEDDDFRLPPGRQRELGFTFSFPVKQLSIASGTLIKWTKGFSIDDTVGQDVVRELTKAMERVGLDVRVAALVNDTVGTLAGGRYNNPDVIAAVILGTGTNAAYVERANTIPKWHGLLPKSGDMVINMEWGNFRSSHLPVTEYDQSLDTESLNPGEQIYEKMISGMYLGEILRRVLCRMAEEASFFDDYVPPKLKTPFILRTPDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAESIVIELSNDGSGIGAALLAASHSQYLGLEES

SEQ ID NO: 8379 - protein, 488 aa, Kuckuckia spinosa
  unsure (1)..(488): unsure at all Xaa locations
MPEDVQIRTRIKSERYESGVIPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPFLGATVKPKLGLSGKNYGRVVYEGLTGGLDFLKDDENINSQPFMRWKERFLYCMEGVNRAAAATGEVKGSYLNITAATVXQMYERAEYAHAIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWASLRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATGSR

SEQ ID NO: 8380 - protein, 429 aa, Bacillus anthracis str. A2012
MVEKRIPIQVAEAVERVMEYAKIGEVEEVSITESYGRILGEDVVSDHDVPHFDRSPYDGFAIRAEDTKEANQENAIEFEVIGEIGAGSVFTEEVGSFQAVRIMTGAAIPADCNAVVMLELTEGFEKNGKTYMKLKRPFHSGDNVSFKGEDIKQNQVLVKKGAVINPGVAALLATFGYSNVKVVKQPVVGIVTTGSELLEVHESLQPGKIRNSNSYMIAAQIMKAGGKVRYYGQLADELDACFTAVQSAIEEVDILITTGGVSVGDYDYLPAIYERLQANVLFNKIAMRPGSVTTVAEVDGKLLFGLSGNPSACYVGFELFVHPVIKTYLYAKEPHVYRADAILQKDFPKPNPFTRFVRAKVTIVDGALHAMPVGLDKSSAVSSLADANAFIVLPGGTRGFETGMKVSVLLLEHAEGCDWPWAKPLQSYK

SEQ ID NO: 8381 - protein, 479 aa, Oryza sativa
VVEATFNSAVSLGVKAIGWRPEWRFKWEPLAGADEEKGRGEYPMVMVQIPMYNELEVYKLSIGAACELKWPKDKLIVQVLDDSTDPFIKNLVELECESWASKGVNIKYVTRSSRKGFKAGALKKGMECDYTKQCEYIAIFDADFQPEPNFLLRTVPFLMHNPNVALVQARWAFVNDTTSLLTRVQKMFFDYHFKVEQEAGSATFAFFSFNGTAGVWRTTAINEAGGWKDRTTVEDMDLAVRASLNGWKFIYVGDIRVKSELPSTYGAYCRQQFRWACGGANLFRKIAMDVLVAKDISLLKKFYMLYSFFLVRRVVAPMVACVLYNIIVPLSVMIPELFIPIWGVAYIPMALLIITTIRNPRNLHIMPFWILFESVMTVLRMRAALTGLMELSGFNKWTVTKKIGSSVEDTQVPLLPKTRKRLRDRINLPEIGFSVFLIFCASYNLIFHGKTSYYFNLYLQGLAFLLLGFNFTGNFACCQ

SEQ ID NO: 8382 - protein, 1261 aa, Oryza sativa
MVDTRRSAAAKRRASSEEAASPATDGAAAGAGAAGSSTPRRRSGKRAKAEATVGTPAAKAGGADATAAAAIDVIDSSVENLHGVARPTGAVPASSTVSNSGVKKKRTKYINVPSAEELSLWKARQAVANGRAEAWGRLISQSSELLPHSQRLAANVVLARGREAVLVAAPVHVVTLVHHPDNDRPSIHGGGDDDADPPVAAAAACATTAVVEAQPPRPGVQLDDQLHVPAEAHMQRRDRRRMSDTGCEPHEPRVALADDAAVRASLGAPGTSSRFRGVGIAAAAGVAAASSRDAMPPWIMGEAESKHMTCKRRAQLVAHDLSEWVGRDLWIDPDLNPWIESIPTRKITPPFGDSGGWPSIDGSRRCHTLGRSNGDCTARVFSQSAKSPSVPIYTTHFTVGHGGNYDLRLTESFPGSLICKLKHVKRGAALEIYVSKAVHVNGKIFQQLPEERSSTSTFSATCAFQQGQYPVTKDTEIVSSLCKTMEEQSQLASEENLQVAQHQLLKEDLKKVVVNASDISDSFDSFPYYLSENTKNALLSSAYVNLCCKESIKWTKHISSLCQRVLLSGPAGSEIYQESLVKALTKHFGAKLLIIDPSLLASGQSSKSKESESYKKGDRVRYIGSVQSTGIILEGQRAPDYGSQGEVRLPFEENESSKVGVRFDKKIPGGIDLGGNCEVDRGFFCPVDSLCLDGPGWEDRAKHPFDVIYEFASEESQHGPLILFLKDVEKMCGNSYSYHGLKNKIESFPAGVFIVGSQIHTDSRKDKSNSGSPFLSKFPYSQAILDLTFQDSFGRVNDKNKEALKIAKHLTKLFPNKVTIQTPQWKQLLDRDVEILKAKANTSKIQSFLTRNGLECADIETSACVKDRILTNECVDKVVGYALSHQFKHSTIPTRENDGLLALSGESLKHGVELLDSMQSDPKKKSTKKSLKDVTTENEFEKRLLGDVIPPDEIGVTFEDIGALENVKETLKELVMLPLQRPELFSKGQLMKPCKGILLFGPPGTGKTMLAKAVATEAGANFINISMSSIASKWFGEGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKNLCVTAAHCPIREILEREKKERASAEAENKPLPPPRSSSDVRSLRMNDFKHAHEQVCASITSDSRNMTELIQWNDLYGEGGSRKKTSLSYFM

SEQ ID NO: 8383 - protein, 195 aa, Lactuca sativa
IQVAAQNCWVKKGGAFTGEVSAEMLANLGVPWVILGHSERRALLNETNEFVGDKVAYALSQGLKVIACVGETLEQREAGTTMEVVAAQTKAIADKISSWDNVVLAYEPVWAIGTGKVASPAQAQEVHAGLRKWFCDNVSAEVSASTRIIYGGSVSGSNCKELGGQTDVDGFLVGGASLKPEFIDIIKAAEVKKSA

SEQ ID NO: 8384 - protein, 345 aa, Actinobacillus pleuropneumoniae serovar 1 str. 4074
MALKDLDWANLGFSYIKTDYRFIAHWKDGKWDEGQLTTDNTLHIHEGSTALHYGQQCFEGLKAYRCKDGSINLFRPEENAKRMQGTARRLLMAEVPTELFVRACKEVVKANQDWLGPYGSGATLYLRPFLIGVGDNIGVKAAPEYIFSVFCCPVGAYFKGGLAPSNFITTDYDRAAPVGTGGVKVGGNYAASLLPHELAVQQGTATRKFADAIYLDPKTHTKIEEVGAANFFGITKDNKFITPASESILPSITKYSLLHIAKERLGMETIEGDVYIDQLDQFAEAGACGTAAVITPVGGIQHKDNFHVFYSETEVGPVTKRLYAELTGIQFGDVEAPEGWIVKVE

SEQ ID NO: 8385 - protein, 469 aa, Porphyra aestivalis
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 8386 - protein, 310 aa, Staphylococcus hominis
GFGRIGRLAFRRIQDVEGIEVVAVNDLTDDEMLAHLLKYDTMQGRFNGDVEVVEGGFRVNGKEVKSFEEPDASKLPWGDLDIDVVLECTGFYTEKEKAEAHINAGAKKVLISAPAKGDVKTIVFNTNHKDLDGSETVVSGASCTTNSLAPVAKVLNDEFGIVEGLMTTIHAYTGDQMTQDGPHRKGDKRRARAAAQNIVPNSTGAAKAIGKVIPEIDGKLDGGAQRVPVATGSLTEVTVVLEKEVTVEDVNKAMKNAADESFGYTEDEIVSSDVAGMNFGSLFDATQTRVISVGDKQLVKVAAWYDNEMS

SEQ ID NO: 8387 - protein, 116 aa, Haemophilus influenzae
MPIIGVCLGHQALIQAFGGKVVHAGEVLHGKVSRISHDNEAMFKDLANPMPVARYHSLMGQDLPKEFIVNAEYNGIIMAIRHRDLPICAFQFHPESILTVQGSQLLQQSIEWLLNR

SEQ ID NO: 8388 - protein, 82 aa, Glycine max
  unsure (1)..(82): unsure at all Xaa locations
DEKLATQIASRAQSLVEGSGSIRVWEYMPIADVGGLQELLXCDSNXARTMAWSERMSVGWMQRELMXILSYAMGITEDQIYT

SEQ ID NO: 8389 - protein, 469 aa, Oryza sativa
GWHLEEVASLLAVDGLFAASYAGFKGIKPVPQAAAAGKPDVEAGAGDYPMVLVQMPMCNEREVYQQSIGAVCNLDWPKSNFLVQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNVNLCFHFEVEQQVNGAFLNFFGFNGTAGVWRIKALEDSGGWMERTTVEDMDIAVRAHLKGWKFVFLNDVEIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 8390 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 8391 - protein, 381 aa, Oryza sativa (japonica cultivar-group)
MATFSGTDRLRDLQAFDNTKAGVKGLVDAGVTAIPYFFRHHPDPLPIAAPSEAAAAILVIDLAKADVDRGHVVSQVRSAAETVGFFQVVNHGVAGELMEEMLAAVRRFHEEPLEAKVPYYTRDVASKVWFNSNFGLFRNGFRSPEANWRDTMFVEMFPEAPSPEEIPPPCRGVLEVYAAAVRRLGERLFELLSEALGLPVGYLGRDAGCMDGLSLSVAAHYYPACPEPEATMGATKHSDPSFLTVLLQDTSGGLQAVLPRPPEERWVDVPPVAGALVVNVGDLLQLVSNDRLRSVEHRVLPTGAAGPARVSVACFFRHAYASTRPCVPVVVGGGGARAAAVYRSTTAGEFLAHYNGKGLDGRSALDHFRLPAAASSPPPPL

SEQ ID NO: 8392 - protein, 367 aa, Oryza sativa
FTSIFCRVKTAKKPYTPPREVHLQVKHSLPPQKREIFDSLQPWAKENLLNLLKPVEKSWQPQDFLPDPSSDGFYDEVKELRERAKEIPDDYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFISHGNTARHAKEYGDLKLAQICGTIAADEKRHETAYTKIVEKLFEIDPDYTVLAFADMMRKKISMPAHLMYDGKDDNLFEHFSAVAQRLGVYTARDYADILEFLVQRWKVADLTGLSGEGRRAQDFVCTLAPRIRRLDERAQARAKQAPVIPFSWVYDRKVQLLISGTNQ

SEQ ID NO: 8393 - protein, 375 aa, Saccharomyces cerevisiae
MGITLYTNIGLVHKRVYKHDRKTDVDRKNHGGTIDISYPTTEVVGHGSFGVVVTTVIIETNQKVAIKKVLQDRRYKNRELETMKMLCHPNTVGLQYYFYEKDEEDEVYLNLVLDYMPQSLYQRLRHFVNLKMQMPRVEIKFYAYQLFKALNYLHNVPRICHRDIKPQNLLVDPTTFSFKICDFGSAKCLKPDQPNVSYICSRYYRAPELMFGATNYSNQVDVWSSACVIAELLLGKPLFSGESGIDQLVEIIKIMGIPTKDEISGMNPNYEDHVFPNIKPITLAEIFKAEDPDTLDLLTKTLKYHPCERLVPLQCLLSSYFDETKRCDTDTYVKAQNLRIFDFDVETELGHVPLVERPAIEERLKHFVSAPSSSL

SEQ ID NO: 8394 - protein, 404 aa, Vibrio vulnificus CMCP6
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 8395 - protein, 433 aa, Aeromonas hydrophila [sequence omitted]

SEQ ID NO: 8396 - protein, 538 aa, Sphingomonas paucimobilis
MTARGLTVEKPARAEGPTVRDAVMTLLRDLGMTTLFGNPGSTELPLFRDMPQDFRYILGLQESVVVGMADGFAQMSGNAAFVNLHSSAGTGHALGNIFTAFRNQTPLVITAGQQARSIFPYDPFLYAERATEFPQPFVKWTCEPARAEDVPLAILRAYHMAMQAPRGPVFVSVPIDDWDRACTPIDVSTVSQDVMASPALIGAAAEALDKARSPVIVAGAGVGRENARAALAKLAEAHKARVFVAPMAARAVFPEDHPLFAGFLPASREAVVSALKGHDLVLVLGAPVFTYHVEGFGPYVPEGASLIQIVDDPSVAARTPVGTAIIGNVADAIARLSAATSPAPPRAVPDAALPAPNVVGSGTAIEEALLMQQLATLRPKGIIISEEAPSTRGPMHDHFPIRLEDEFMATASGGLGFALPAAVGAAIAQPDRTVLCLLGDGSSMYSIQGLWTAAEMGLDVRFLIVNNGGYAALDQFGALFDIEVVGSKLPGLDFVKIAEGMGVPGARVSTVDALDEAIRELFAGKGPRLLEVVVQRPA

SEQ ID NO: 8397 - protein, 373 aa, Oryza sativa (japonica cultivar-group)
MEAEKKPPAVSDVGAWAMNVVSSVGIIMANKQLMSSSGYAFSFGTLRAFARSSSSPFPSPQIWIRRFGFVPATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFADYYLNGRWLLNYNFSTGATFFILLSCSLAVFCNMSQYLCIGRFSATSFQVLGHMKTVCVLILGWILFDSALTVKNILGMLLAVMGMVVYSWAVETEKKASAPIPRNKSDMLDDSEDVPLKARVSGLPSSDLEEGEMKS

SEQ ID NO: 8398 - protein, 411 aa, Oryza sativa
  unsure (1)..(411): unsure at all Xaa locations
MAVTAEVESSPAATGKLRYNSPLVQVSLIGLVCFCCPGMFNALTGLGGGGQLDHSTADNANTALYSXFAVFGVLGGAAHNLLGPRVTLLAGALTYPLYAASFLYYNHHPSRQAFPVTAGALLGVGAGLLWAAQGAIMTSYPPPSRRGSYISLFWCLFNLGGVLGGLLPFSLNYHRAADATSVNXDATYIAFMAFMLLGAGLALLLLPASRIXQQRQWPPLSPAAQGPQQRLLLGXPDARVRGHRLLPRLRIRILQQREGPVRGRRRRRARHRHLAGGLANHVPYADGNWGERLIDFKDGRRSAPSRIXNYWYVPFHLASQSSCISKGCELFKYVGFYKGVQSAGAAVAWQIDTHKTSLISQLIVNWALTTVSYPLLALLVFLAVKEEDSSVSSVEDGKEKDSKLSAPTSFH

SEQ ID NO: 8399 - protein, 245 aa, Zea mays
  unsure (1)..(245): unsure at all Xaa locations
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWEEADFIKVSXDDEVAFLTRGDATDEKXVLSLWFEGLKLLIVTD

SEQ ID NO: 8400 - protein, 811 aa, Clostridium perfringens str. 13
MLSINKESFKRDYKKKFLELHGIELEEGKNFHKYEALGCLVRDYIAEDWVNTKKKYESSKQKQVYYFSMEFLLGRLLGDALLNLGIRETCREALKELNIDLEELEEFESDQGLGNGGLGRLAACFLDSMASLNIAGHGCGIRYKYGFFNQKIIDGSQVETPDSWLKNGNVWEFKKLDKSEVVKFGGNIKCENINGRLTFTHVNYEPILAVPYDTPIVGYENNVVNNLRLWSAEPVDNEFDFCYFNRGQYLKAIEYRNSIEAISQVLYPDDSMYEGKLLRLKQQYFFVSAGLQSIVRHYKKNGGKIEEFDEYIAIHINDTHPTLAIPELMRILLDEEGLSWESAMRITTNTISYTNHTILSEALEKWPINMFKELLPRIYMIVEEMNERYCAELWHKYIGQWDKISKMAIIGDGFVRMANLAIVGSHSVNGVAKLHTEILKKKEMSDFYYLYPSKFNNKTNGIAHRRWLLKSNPELTNLLKETIGDSFIKHPTDMENFEKYIDDEYVLKRLGEIKRKNKENLAKVILDNQGIKVDPNSIFDVQVKRIHAYKRQTLNCLRIMELYNRLLENPNLDIAPRTFIFAGKAAPAYYLAKNTIELINAVAKKVNNDKRINDKIKVVFLENYRVSLAEKIIPATDLSEQISTTTKEASGTSNMKFMMNGAVTIATLDGANIEIRDEVGDDNIVIFGLTENEVLDYYSRGGYSAWDVRNNDNRLIRVTDDLINGVYSKDRDKFRSVYDNLLTYNDEFFVLKDFDSYLKAQDKVDLLYRNNKEWQRKCGVNIAHSGIFSSDRTITEYATGIWGSKVIYKNL

SEQ ID NO: 8401 - protein, 404 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 8402 - protein, 161 aa, Zea mays
  unsure (1)..(161): unsure at all Xaa locations
ARTVRCAVTLGPKLSETVKGKLSLGARILQAGGVERVFRQAFSVADDKGERLLKALQCYIYTTGGPIAGMLFVSTRKVAFRSDRPITVTSPGPRGGTARVTYKAAIPLRRIKRVRPSESAEXPEHKYVQVATVDGFEFWFMGFVSYQRCCKYMQQVVSDLQ

SEQ ID NO: 8403 - protein, 497 aa, Cladosporium fulvum
MSLSVQLETPSAGKYEQPTGLFINNEWVKPVSGKFFDVINPTDESVICQVAEADEKDVDIAVAAARKAFEGPWRQETPENRGKLLVKLAELFEKNLDLFASVKALDNGKAFNMAKVDIGMCAGCLRYYGGWADKIEGKVVDTTPDTFNYIKKEPIGVCGQIIPWNFPLLMWAWKIGPAVATGNTVVIKTAEQTPLGAYVAANLIKEAGFPPGVVNVISGFGKVAGAAIASHMDIDKVAFTGSTVTGRTILKAAAGSNLKKVTLELGGKSPNIVFDDADIDNAISWVNFGIFFNHGQRCCAGSRIYVQEGIYDKFLQRFKERAQKNVVGDPFAADTFQGPQVSQVQFDRIMGYIQAGRDAGATVEIGGNRKGDKGYFIEPTIFANVTEDMKIMQEEIFGPVCSISKFKTKEDAIKVGNATPYGLAAAVHTRNLNTAIEVSNALRAGTVWVNTYNTLHHQLPFGGFKESGIGRELGEDALANYTQTKTVSIRLGDALFG

SEQ ID NO: 8404 - protein, 495 aa, Zea mays
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDHVGVPSDYRHMEGFGVNTYTFVSAAGKAQYVKFHWKPTCGERSILTDEEARVGGRNHSHTQDLYDSIAAEGSFPEWTLYVQVMDPAQQEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVKAIRRLARTPKRQPELRSIWIDLLAKVDASLGMKIATRLNMKANM

SEQ ID NO: 8405 - protein, 296 aa, Salmonella typhimurium LT2
MSFFHANQREALNQSLAEVQGQINVSFEFFPPRTSEMEQTLWNSIDRLSSLKPKFVSVTYGANSGERDRTHSVIKGIKERTGLEAAPHLTCIDATRDELRTIARDYWNNGIRHIVALRGDLPPGSGKPEMYAADLVGLLKEVADFDISVAAYPEVHPEAKSAQADLLNLKRKVDAGANRAITQFFFDVESYLRFRDRCVSAGIDVEIIPGILPVSNFKQAKKFADMTNVRIPSWMSLMFEGLDNDAETRKLVGANIAMDMVKILSREGVKDFHFYTLNRAEMSYAICHTLGVRPGL

SEQ ID NO: 8406 - protein, 565 aa, Schizosaccharomyces pombe
MTVSLNTMMGVDGLEDQEQLREIRNCLLKCISECSERGLVYAVRWAAEMLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 8407 - protein, 195 aa, Syrrhopodon loreus
GGAKKVVISAPSKDAPMFVMGVNEEKYTNEDIVSNASCTTNCLAPLAKVINDKFGILEGLMTTVHATTATQKTVDGPSNKDWRGGRSASTNIIPSATGAAKAVGKVLPELNGKLTGMAFRVPTTDVSVVDLTVRLEKPASYDAIKAALKEASQGKMKGILGYTEDDVVSSDFITDSRSSIFDAKAGISLSDTFAK

SEQ ID NO: 8408 - protein, 452 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 8409 - protein, 486 aa, Ralstonia eutropha
MNAPESVQAKPRKRYDAGVMKYKEMGYWDGDYEPKDTDLLALFRITPQDGVDPVEAAAAVAGESSTATWTVVWTDRLTACDMYRAKAYRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKGGLDFMKDDENINSQPFMHWRDRFLFVMDAVNKASAATGEVKGSYLNVTAGTMEEMYRRAEFAKSLGSVVIMIDLIVGWTCIQSMSNWCRQNDMILHLHRAGHGTYTRQKNHGVSFRVIAKWLRLAGVDHMHTGTAVGKLEGDPLTVQGYYNVCRDAYTHTDLTRGLFFDQDWASLRKVMPVASGGIHAGQMHQLIHLFGDDVVLQFGGGTIGHPQGIQAGATANRVALEAMVLARNEGRDILNEGPEILRDAARWCGPLRAALDTWGDISFNYTPTDTSDFAPTASVA

SEQ ID NO: 8410 - protein, 606 aa, ASPERGILLUS NIDULANS FGSC A4
MSFPLTYPTTRSLTGGDLLAQSLKQLGVTVAFGLHGGHLDAFLMGCESVGIRLIDTRHETAAVQAAEGYAKVSAGIGVAFVTANSGFSNGIPGLASALADRSPILVVTSSPPLRDSENNSLQGIIDQVVASRTLTKFAHRVTNPEDAPRLVSLAVRTATAGAPGPALLDFPIDVLFTPVHENLISWGSITSPRSYAPGPHVEAVKDAVGLLKAATRPAIIIGSGGQGEETTAHLLSLSNSHNIPVFDTQKCMLSSTLSWKCKFYGGSADKLALLPAVQAPHPDLIFLLGARTGMFLGGRSGAIIPFHDKCKLIHVDVDGGEIGRTLPVDLGVISDVGQFVSSLDDQLRSLPATGNKKTDADWVSKVISIKARPSPWDSDRETTLSGRMHPHHALKALFTSLSSDPRIQDPILVLDGGECALWAHSLAHILNPRAILKSTGALGFLGNGFGYTLGAAIAAPRTKVINVQGDGSAGFHLMELDTYARLGVEVITVVMNNHCWGMSSNGQQLVYGDLNPKRPVSTLSAVTEYADVSRGLGNRGFKAQRVEEVLDAAHELLEREGPACLELIVDSKPIHPVTEMMVGKTEDPDLVVVPYYDNIPRAYYKV

SEQ ID NO: 8411 - protein, 468 aa, Phyllariopsis brevipes subsp. brevipes
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKRRFLYCRRGVNRSAAARGEVKGSYLNVTAATMEQMYERAEYSHAIGSVICMIDLVVGYTAIQTMAIWARKAEMILHLHREGNSTYARQKNHGINFRVICKWMRMCGVDHIHAGTVVGKLEGDPLMVKGFYNTLLLTQLKINLAEGLFFDMNWPSLRKCVPVASGGIHCGQMHQLLYYLGDDVVLQFGGGTIGHPDGIQSGATANRVALEAMVLARNEGRDYVSEGPEILRNAASTCGPLKAALDLWKDITFDYTSTDTPDFVEVPTESN

SEQ ID NO: 8412 - protein, 361 aa, Saccharomyces cerevisiae
MKGLILVGGYGTRLRPLTLTVPKPLVEFGNRPMILHQIEALANAGVTDIALAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 8413 - protein, 99 aa, Zea mays; identical to SEQ ID NO: 3237

SEQ ID NO: 8414 - protein, 398 aa, Zea mays
MDGGGQPPDTEMSEAGAGGGGQPPQQPLPPVGGGVMLDNIQATLSHGGRFIQYNIFGNVFEVTAKYKPPVLPIGKGAYGIVCSALNSETAEQVAIKKIANAFDNKIDAKRTLREIKLLRHMDHENIVAIRGIIPPAQRAAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEGDLDFVNENARRYIRQLPRHPRQSLPEKFPHVQPLAIDLVEKMLTFDPRQRITVEGALAHPYLASLHDISDEPGCSMPFSFDFEQHALSEEQMKDLIYQEALAFNPDYQ

SEQ ID NO: 8415 - protein, 293 aa, Zea mays
YAPLVDARRKDPAIQATYRRSELPFLPPAASYFLDKAVDISRTEYELSDMDILYADGITSSDGVASTEFSFPQLSLGGLGVDEPDAQDTLLRYQLIRINSRGLHGNCKWLQMFDDVRLVIFCVAASDYDEFYEDANGTIVNKMVESRQLFESITLHPTFEQADFLLLLTKFDLLEQKISSSPLTSCDWFSDFTPLISRNLLNGGSGGRRRTARSSTGATLPQMAAHYMATKFKRLFESMTGRKLYVSYVNALDQESVRSAIRYGREVVKWEEEKPVFGASETVYSEEPSSFTA

SEQ ID NO: 8416 - protein, 433 aa, Desulfovibrio desulfuricans G20
MIAKKTSSGLLLAFFRLPAGDCNFLFLLQEESMNAADTAFILVCSALVMFMTPGLALFYGGLVRSRNVLSTTMHSVALLGIASLVWWAVGYSLAFGSDHGGIIGGLEYLFLHNVGTEPGPVDNLPHLLFMVFQCMFAVITPALISGAYAERIRFGAMVLFSVLWLVLVYAPMAHWVWGGGWMARLGALDFAGGAVVHMSSAAAALAAANVLGLRRGYGREAFIPHNLPMTVLGAGILWFGWFGFNAGSALAANGAAANAFVTTHLAAAAALVGWLAVEKLHGGRATTLGAASGAVAGLVAITPAAGFVTPASAVFIGLAGGVLCYGGVFLKHKLRYDDALDVVGIHGVGGTWGALATGIFADAAVGGADGLLHGNAYQLWVQFVSVVATWLFCYVASWLLFKAVDAVMGLRVSGEAELAGLDVSEHNETAYQM

SEQ ID NO: 8417 - protein, 145 aa, Morus alba
EDGMKIQGYNGSQLWDASFAVQAIISTNLINEYGSTLRKAHTFIKNSQVSEDCPGNLDFWYRHISKGAWPFSTADHGWPISDCASEGLKAVLLLSKLPSDIVGEPIESKQLYDAVNVVLSLQNGDGGFATYELTRSYAWLEFINP

SEQ ID NO: 8418 - protein, 107 aa, Glycine max
  unsure (1)..(107): unsure at all Xaa locations
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 8419 - protein, 387 aa, Zea mays
NLVDPRLAVEQNGQNADASTNGASATTLEATQPVSPWGDVDHLLDGYDDQQKALIQKERARRITEQHKMFSARKLCLVLDLDHTLLNSAKFIEVEPIHEEMLRKKEEQDRTLPERHLYRFHHMNMWTKLRPGIWNFLQKASNLFELHLYTMGNKLYATEMAKVLDPTGTLFAGRVISRGDDGDPFDSDERVPKSKDLDGVLGMESAVVIIDDSVRVWPHNRHNLIVVERYTYFPCSRRQFGLPGPSLLEIDRDERPEDGTLASSLAVIERIHHNFFSHPNLNEADVRSILASEQRRILTGCRIVFSRVFPVGDASPHLHPLWQTAEQFGAVCTNLVDDRVTHIVANSPGTDKVNWALSKGKFVVHPGWVEASALLYRRANEHDFAVK

SEQ ID NO: 8420 - protein, 507 aa, Thermosynechococcus elongatus BP-1
MKLRSILRRGFRLQHPLTQILYLPTRRTLLTFAVMIGVLSATAALGQDTAASAAVPEKVQVALNTLWVILAGVLVFFMNAGFGMLETGFCRAKNAVNLLSKNLIVFALASISYWAIGFALMFGDGNGVLGSSGFFLLGADNSPATGEAYRGVYSSLSWAAVPLSAKFFFQLVFAGTAATIVSGAVAERIKFYAFFIFSLLLVGISYPITGHWIWGGGWLQQLGMWDFAGSTVVHSVGGWAALMGAALLGPRLGRFLPDGSVAAIPGHNFAIATLGCLILWLGWFGFNPGSTMAADPGAIAHIAVTTNMAAAFGGVTATVVSTLYFGKPDLSMIINGILAGLVAITASCAFVTIESAALIGAIAGTIIVFSVVTIDRLKIDDPVGAISVHLVNGVWGTLAVGLFADGPGRFYEAGAGPLKGLLWSGDFTQFGYQLVGVLAVGGFTVAFSTAVWLLLNATIGIRVSPEEEIEGLDIGEHGMEAYAGFLLREEVKGFVDLLKRMSGSGRS

SEQ ID NO: 8421 - protein, 308 aa, Desulfovibrio desulfuricans G20
MTPSQARMLPVLALLVTMLLWSSSFIAMKVAVMELDPMLVMFGRMTAASLCFACCWRSLRRVTYRKGDWKPLLFMSLCEPCAYFVFEAYALRYTSASQAGMVVSTMPLFVAMAAFIFLRERLSRQVWAGFAVALCGVVWLTLAGEATEHASNPLLGNILECLAMASATGYVVTAKRLSSHYPPLFITAVQAFTGMVFFMPLAFRPGTALPETIPLLPALAVVYLGVAISLVAYGFYNYGVSKMPAGQASAFINLIPVLTLLMGQVFLDEVFTPQQYVAAALVLAGVVLSQTGSAADSGQQDTGRQNTV

SEQ ID NO: 8422 - protein, 176 aa, Glycine max
SARAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 8423 - protein, 185 aa, Zea mays
PRVRDVCNGLLGGFAAITAGCSVVDPWAAVICGFVSAWVLIGLNALAARLRFDDPLEAAQLHGGCGAWGVLFTGLFARREYVEQIYGTPGRPYGLFMGGGGRLLAANVVMILVIATWVSVTMAPLFLALNKMGLLRVSAEDEMAGMDQTRHGGFAYAYHDDDLSLSSRPKGMQSTQIADAASGEF

SEQ ID NO: 8424 - protein, 407 aa, Zea mays
LQREGRVLRGLSSPHIVPCLGSRAAAGGEYQLLLEFAPGGSLADEAARSGGGRLAERAIGAYAGDVARGLAYLHGRSLVHGDVKARNVVIGGDGRARLTDFGCARPAGGSTRPVGGTPAFMAPEVARGQEQGPAADVWALGCMVVELATGRAPWSDVEGDDLLAALHRIGYTDDVPEVPAWLSPEAKDFLAGCFERRAAARPTAAQLAAHPFVVASASAAAAIRGPAKQEVVPSPKSTLHDAFWDSDAEDEADEMSTGAAAERIGALACAASALPDWDTEEGWIDLQDDHSAGTADAPPAPVADYFISWAEPSDAELEPFVAVAAAAGLPHVAGVALAGATAVNLQGSYYYYPPMHLGVRGNEIPRPLLDHHGDGLEKGQGSHRVCNRETEKVTMKRISLKEDPLSL

SEQ ID NO: 8425 - protein, 346 aa, Cytophaga hutchinsonii
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 8426 - protein, 246 aa, Cathaya argyrophylla
YTYTLRNTEPEDVIIRVIYCGICHSDLVQMHNEVGMSRYPMVPGHEVVGMVTEIGSEVKKFKVGEHVGVGCIVGSCRSCPNCKESMEQYCNKRIWTYNDVNPDGTATQGGFASSMVVNQMFVVRIPENLPLEQAALLLCAGVTVYSPMKHFGMTEPGKRCGILGLGGVGHMGVKIAKAFGLHVTVISSSDKKKEEALEVLHADAYLVSKDTEKMREAAESLDYILDTIPVGHPLEPYLALLKTNGK

SEQ ID NO: 8427 - protein, 314 aa, Arabidopsis thaliana
MEENLPPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTAAKKAQEQQPQSSQPSFGSPCDANSSMANEFEDIDELPNLNSNSSTIDYNNHIHQYSQRNVYSEDNTTSTAGLNMNMNMASTNLQSWTTSLLGPPLSPINSLLLKAFQIRNSYSFPKEMIPSFNHSSLQQGVSNMIQNASSSSQVQPQPQEEAFNMDSIW

SEQ ID NO: 8428 - protein, 475 aa, Ralstonia metallidurans
MYQDLALYIDGEFIKGGDRREQDVINPATQELLGKLPHATTADLDRALSAAQRAFETWKKTSPLERSQILRRVAELTRTRAKEIGRDITLDQGKPLAEAVGEVMICAEHAEWHAEECRRIYGRVIPPRNPAVRQIVVREPIGVCAAFTPWNFPFNQAIRKIVAALGAGCTLILKGPEDSPSAVVALARLFHDAGLPPGVLNIVWGVPSEVSTYLIESPIVRKISFTGSVPVGKQLAAMAGAHMKRVTMELGGHSPVLVFGDADIEPAAEMLARFKLRNAGQVCVSPTRFYVQEKAYDKFLARFTEVIGSIKVGNGLDDGTQMGPLAHERRIASMEQFLDDASHRGGKIVAGGSRIGDKGFFFAPTVVTDLPDDAKLMVDEPFGPVAPVTRFKDAEEVLRRANSLPFGLASYVFTNSLKTANLVSNGLEAGMVNINHFGMALAETPFGGIKDSGIGSEGGQETFDGYLVTKFITQV

SEQ ID NO: 8429 - protein, 511 aa, Debaryomyces occidentalis
MRFSTEGFTSKVVAAILAFSRLVSAQPIIFDLADVSSSADLWLDQSIYQIVTDRFAASDGSTTADCLVSDRLICGGSYLGIIDLLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYDLGEVYQGDPTYTCPYQNYMKGVTNYPLYYPVYRFFSDTSATSSELTSMISTLHSSCSDVSLLGNFIENHDQVRFPSVTDTSLIKNAMAFIILGDGIPIIYYGQEQGLNGGSDPANREALWLSGYNTDSEYYELISKLAQIRNQAIKKDSAYSTYKSSVVSSSDHYIATRKGSDANQLISIFNNLGSNGSQDITVSNTGYSSGDKVIDIISCNSVSAGDSGSLSVSISGGMPQVYAPSSVLSGSGICNQ

SEQ ID NO: 8430 - protein, 443 aa, Leptocladia conferta
  unsure (1)..(443): unsure at all Xaa locations
VSPQPGVDPVEASAAVAGESSTATWTVVWTDLLTACDLYRAKAYKVDAVPNTSDQYFAYIAYDIDLFEEGSIANLTASIIGNVFGFKAIKALRLEDMRLPIAYLKTFQGPATGIIVERERMDKFGRPFLGATVKPKLGLSGKNYGRVVYEGLRGGLDFLKDDEXXNSQPFMRWKERFLYSMEAVNRSIAATGEVKGHYMNITAATIEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIKGFYNTLLEPYLAINLPQGIFFEQDWASLRKVTPVASGGIHCGQMHQLLDYLGVDVVLQFGGGTIGHPDGIQAGATANRVALESMVIARNEGRDFVKEGPQILQDAAKTCGPLQTALDLWKDITFNYTSTDTSDFVETPTANV

SEQ ID NO: 8431 - protein, 490 aa, Lotus japonicus
VALMILRKNLKKPDSIPNIPPGPWKLPIIGSIPHLVGSPPHRKLRDLAKKYGPLMHLQLGEVIFIIVSSAEYAKEVMKTHDVTFASRPRSLFTDIVFYGSTDIGFSPYGDYWRQVRKICNVELLSMKRVQSLWPIREEEVKNLIQRIASEEGSVVNLSQAIDSLIFTITSRSAFGKRYMEQEEFISCVREVMKLAGGFNIADLFPSAKWLENLTRMRSKFEYLHQKMDRILETIIDDHKANSRTKEGQVEGGEEDLIDVLLKYENSSTDQDFHLTIRNIKAILFDIFIAGSETSATTINWTMAEMMKDPILLKKAQDEVREIFQRRGKVDETCIYELKYLKAFINEVLRLHPPGPLVFRECRQACEINGYHIPAKSTVLVNTFAIGTDSKYWAEPERFCPERFIDSSIDYKGTNFEHLPFGAGRRICPGINYGMANVELVLALLLYHFDWTLPKGIKNEDLDLTEEFGVTVSKKEDLCLIPSISHPLPST

SEQ ID NO: 8432 - protein, 362 aa, Triticum aestivum
MEEIGHHFGLGATAHGQHHSQLPWGSSPLSAVIAPPPQQQQQQQSAGYLAHSPLSLNTAPPSGSHGGGTGCSNPVLQLANGSLLEACAKAAKEPSSSSYAADVEAIKAKIISHPHYSSLLAAYLDCQKVGAPPEVLARLTAVAQDLELRQRTALGSFGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 8433 - protein, 333 aa, Pseudomonas syringae pv. tomato str. DC3000
MTLRIAINGFGRIGRNVLRALYTQGYRQDLQVVAINDLGDSEMNAHLLRFDTVHGPFSGTVECDKESLTVNGDRISVSAIRNPAELPWKAQDIDVVFECTGLFTSRDKAAAHLTAGARKVIISAPASGADATIVYGVNHDTLRQSHQIISSASCTTNCLAPVAQVLHRELGIESGLMTTIHAYTNDQNLIDVYHTDPYRARSATQSMIPSKTGAAEAVGLVLPELAGKLTGMAVRVPVINVSLVDLTVTLKRETTAEEVNALMKEASQHSKVLGYNTLPLVSHDFNHNPLSSIFDANHTKVSGKLLKVLSWYDNEWAFSNRMLDNCLALHNAE

SEQ ID NO: 8434 - protein, 545 aa, Azospirillum lipoferum
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVRSAATGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADNPLGGLVDALLEWLPRSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDSAFATRGRFQLIEAMIPRGVLSDTLARFVQGQKRLHAAPRD

SEQ ID NO: 8435 - protein, 278 aa, Zea mays
  unsure (1)..(278): unsure at all Xaa locations
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLDKKXGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 8436 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKQYLKEGH

SEQ ID NO: 8437 - protein, 517 aa, Zea mays
  unsure (1)..(517): unsure at all Xaa locations
MVSESNRGGADRTTAAGEERGQLLFDVPEIRFTKLFINGSFVDAVSXRTFETRDPRTGGVIASVAEADKEDVDLAVRAARAAFDHGEWPRMSGSERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAXGCALVVKPXEQTPLSALYLAQLAKQAGVPDGVINVVPGFXXTAGAALXSHMDVDMVSFTGSTEVGRLIMKASXESNXXPXYLELGGKSPLIXXXDADLDMXVELAVGASFFNKGEACVAASRVYVQERVYDRFEERLPERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKSVVTPLRASPWI

SEQ ID NO: 8438 - protein, 471 aa, Pseudomonas aeruginosa UCBPP-PA14
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPLSSYLALAFLVMVVVLMAFFEDTRIALYIGPPFILLLTVLYYAFNLAPKEPAGTGSVSRAAS

SEQ ID NO: 8439 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGIEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 8440 - protein, 252 aa, Glycine max
MEDIGPNSCTRQVAEKKARPQEQLNCPRCNSTNTKFCYYNNYSLTQPRYICKTCRRYWTEGGSLRNVPVGGGSRKNKRVTSSKVPPDLNPPSLSSVSAISSQNPKMQGVHDLNLAFPTAIDNYHGMSPYVEMPKLEIGGDHSTSHSHHHSPSAVELLRSGMASRGLNPYAPNSMMSTSDHSLYTTGYPMQEIKPNLSFSVDDGFGNRSYGVQENGGGRLLFPFGDIKHLSAGVEVEHNKERGNNSTGYWTGW

SEQ ID NO: 8441 - protein, 318 aa, Saccharomyces cerevisiae
RAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVKAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 8442 - protein, 202 aa, Zea mays
  unsure (1)..(202): unsure at all Xaa locations
MQSQIVCHGCRTLLFHPRGAPSVCCAVCHVVTNVPPPAMEMARLICGGCQTLLMYARSATTVRCPCCDTVNLVRPVSSIAHVNCGQCQTVLMYPYGAPSVKCAVCNLITNGWRGDSXIPLPPPALTASSGTSYTIPSISVPTNQPRDVTVVVENPMTVDDKGKLNTYLVSYCCLAIGCSTEEEFPLGECSGKAARLSPLRSC

SEQ ID NO: 8443 - protein, 725 aa, Glycine max
  unsure (1)..(725): unsure at all Xaa locations
RVRIIRNDVSYPVKFYGKVVSGSDGKKHWIGGEDIKAVAHDVPIPGYKTKTTINLRLWSTKAASEEFDLSAFNAGRHTEASEALANAEKICYILYPGDESIEGKILRLKQQYTLCSASLXQDIIARFERRSGTNVNWEEFPEKVAVQMNDTHPTLCIPELHXELLIDVKGLNWKDAWNITQRTVAYTNHTVXPFALEKWSLDLMQKLLPRHIEIIEMIDEELVRTIIAEYGTENSDLLEVLGGINTALWSGYLIHFSGKIDIPGKXFLIQSFFFCFSNRTNPLTRLLMFKVIRKSTXKKNGTDESSIEDEKEELPEPVPEPPKLVRMANLCVVGGHAVNGVAEIHSEIVKDDVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLMNIFGIVYRYKKMKEMSAAEREANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGIFGSYNYDELMGSLEGNEGFGRADYFLVGKDFPSYIECQEKVDEAYRDQTKWTRMSILNTAGSYKFSSDRTIHEYAREIWNIEPVQLP

SEQ ID NO: 8444 - protein, 174 aa, Triticum aestivum
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCEESGKA

SEQ ID NO: 8445 - protein, 177 aa, Triticum aestivum
SGNNPLPPETWMLPYCLPVHPGLMWCHCRMVYLPMCYVYGKRFVGRITPIILELRNELFKVPYSEVDWDSARNLCAKEDLYYPHPLIQDILWATLHKFVEPVMMHWPGNKLREKSLNHVMQHVHYEDENTRYICIGPVNKVLNMLACWIEDPNSEAFKLHIPRIYDYLWVAEDGMKM

SEQ ID NO: 8446 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 8447 - protein, 159 aa, Triticum aestivum
  unsure (1)..(159): unsure at all Xaa locations
VMLITTILLSLVMLIIWDTHVVLVALYFVPFLILEGTYVSAVCTKILKGGWMPFAVSLLLALIMFGWYYGRQRKAEYEMANKVTLERLGELLAGPDVHRIPGLCFFYSNMQDWLTPVLAHYIRNLRSLHKVTXFLTLRYSWWQVMQGRVASGAWTNGLW

SEQ ID NO: 8448 - protein, 493 aa, Prochlorococcus marinus
MQTNFLFMTTALQTPQRRSRSKLQDASLVNGPMLLLRSIRGFSSNRSMLWLATVPLALFGLGIFNLSAHAADLPELNAAFLANNLWLLIATILVIFMNAGFAMVEAGMCRSKNAVNILAKNLFVFALAVTSYWFIGYSLMYGGSVADGWLYFGGLFFDPTVTADMVTDAGLVPTVDFLFQSAFAGTAATIVSGLVAERVKFGEFVVFAIVLTAFIYPIAGSWKWNGGWLDSLGFVDFAGSSIVHSVGAWAGLVGAMLLGPRIGKYSDGKPQAMPGHNMAIATLGALILWIGWYGFNPGSQLAMDQWVPYVAVTTTLAAAAGAIGATIVSTLTSGKPDLTMIINGILAGLVSITAGCGDMTLAGAWFAGLVGGIIVVFSVAALDAAEIDDPVGAFSVHGVCGVWGTLVIGLWGTAVQGDGAGMGLFNGGGINLLLVQALGAAAYAIWTLVTCWIAWSIIGGLFGGIRVSEEEETQGLDISEHGMESYPDFASAK

SEQ ID NO: 8449 - protein, 410 aa, Bacillus subtilis subsp. subtilis str. 168
MSLREEALHLHKVNQGKLESKSKVEVRNAKDLSLAYSPGVAEPCKDIHEDINKVYDYTMKGNMVAVVTDGTAVLGLGNIGPEAALPVMEGKAVLFKSFAGVDAFPIALNTNDVDKIVETVKLLEPTFGGVNLEDIAAPNCFIIEERLKKETNIPVFHDDQHGTAIVTVAGLVNALKLSGKSMSSIKVVANGAGAAGIAIIKLLHHYGVRDIVMCDSKGAIYEGRPNGMNDVKNEVAKFTNQDRKDGSLKDVIVDADVFIGVSVAGALTKEMVQSMAKDPIIFAMANPNPEIMPEDAREAGASVVGTGRSDFPNQVNNVLAFPGIFRGALDVRATHINEEMKIAAVEAIASLVSEDELSADYVIPAPFDKRVAPAVAKAVAKAAMETGVARITVDPEEVAEKTRKLTIIGE

SEQ ID NO: 8450 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 8451 - protein, 320 aa, Triticum aestivum
SNSHSSQEGAAFARAFDDANEQVLYRFFDPLWKAKRLLNVLSEAAMKRSVRTINDFVYAVIDKKIEQMGRDGHEFAKKQDILSRFLLEREKDPGCFDNKYLRDIILNFVIAGRDTSAGTLSWFLYVLCRDQRIQDKIAREVREATTAGRRDVGGLQELTACLTEDAISSMPYLHAALTETLRLYPAVPIDVKYCFSDDTLPDGHAVRKGDMVNYQPYPMGRMKFLWGDDAEEFRPDRWLDGDGVFVPESPYKFTAFQAGPRICLGKEFAYRQMKIFAAALLCLFRFEMWERDSTVGYRPMLTLKMDGPLRVRASPRRASG

SEQ ID NO: 8452 - protein, 278 aa, Hypogymnia physodes
VEHGDVKVVAVNDPFIEPHYAAYMLKYDSQHGQFKGTIEVKGSDLVVNGQTVKFYTERDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTHLNGDNHSCIFDATAG

SEQ ID NO: 8453 - protein, 513 aa, Nitrobacter winogradskyi
MDIRAQVSMVFHLDKCIGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLINAPLADEQPTARAISMVTGKYMDTIEAGPNWDNDLGGSQVYANNDPNFDGASDEEMRQINEINSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPDSKIEAAQKSPVFQFVKKWGIALPLHPEFRTLPMLFYVPPLGPVLAKVENGVYDNVANEARLGPLMSSLERSRIPLRYMASLLSGGNEEIIRDVYKKLVAVRVYMRSRKVKDIPDEEVQRALSEGKTTAAEVEAIWRLTSMPTFEERFVVPPMERETAVDALFPQLDPVSHSYPIRKGAVGVGFHTDPARGP

SEQ ID NO: 8454 - protein, 444 aa, Vibrio vulnificus CMCP6
MSVYYTLCFLSAAAMLIAFVNSKIGKMQTTIAITAGSMVLSLLILIAGQNNWFHLTEIATQTMSSIDFEDFLLKGILGFLLFAGGLGIKLPNLKDQKWEITVLALGATLFSTFFIGFALYGICQLIGIQFDLIYCLLFGALISPTDPIAVLAIVKKLKAPRRISTQIEGESLFNDGFGLVIFVTLFTIAFGHETPTVGSVTMLFIQEAIGGILYGFALGLLFHYLICATDDHSMELLLTIGIPTAGYAFAEVLHVSGPLAMVVSGIMIGNWTRFIGFSKESEDHLDHFWELVDEFLNGVLFLLIGMSMLLFKFHQEDWILMAIAIPLVLIARYLSVFLSYIGFKRFRQYNPWSIKILTWGGLRGGLALAMALSIPSGIWVISDKLIDVKEIILVMTYAVVVFSILVQGSTITPMIEKAKKSEAEFEAKQSSVTVPEGKTESITS

SEQ ID NO: 8455 - protein, 119 aa, Synechocystis sp. WH 8501
MSENKKSGFGIPGLGKIKELQDAFQKAQQVQAGAQQLQEELERMDIEGYSDEQTKLVTVVMSGNQEPRQVTIKPEALQQDADALSALVTAAMKDAYGKSTETMRGKMEELTSGLNLPGM

SEQ ID NO: 8456 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGAPANRVALESMVLARNEGRDYVGEGPEILRRAATTCGPLKAALDLWKDITFDYTSTDTPDFVEVATESR

SEQ ID NO: 8457 - protein, 365 aa, Apium graveolens
MAKSSEIEHPVKAFGWAARDTTGLLSPFKFSRRATGEKDVRLKVLFCGVCHSDHHMIHNNWGFTTYPIVPGHEIVGVVTEVGSKVEKVKVGDNVGIGCLVGSCRSCESCCDNRESHCENTIDTYGSIYFDGTMTHGGYSDTMVADEHFILRWPKNLPLDSGAPLLCAGITTYSPLKYYGLDKPGTKIGVVGLGGLGHVAVKMAKAFGAQVTVIDISESKRKEALEKLGADSFLLNSDQEQMKGARSSLDGIIDTVPVNHPLAPLFDLLKPNGKLVMVGAPEKPFELPVFSLLKGRKLLGGTINGGIKETQEMLDFAAKHNITADVEVIPMDYVNTAMERLVKSDVRYRFVIDIANTMRTEESLGA

SEQ ID NO: 8458 - protein, 479 aa, Centroceras clavulatum
RIKNERYESGVIPYAKMGYWDPEYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIVMIDLVIGYTAIQTMGVWARKNDMILHLHRAGNSTYSRQKIHGMNFRVICKWMRMAGVDHIHAGTVVGKLEGDPLMIRGFYNTLLLTHLDINLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 8459 - protein, 176 aa, Triticum aestivum
  unsure (1)..(176): unsure at all Xaa locations
MAPTVMASSATSVAPFQGLKSTAGLPVSRRSSSAGLSSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 8460 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 8461 - protein, 541 aa, Streptomyces coelicolor A3(2)
MSGNVTSLFRSTAAHSPSMAALARESGEAAGAGPVDFCIPCNPYFPTPAMFDELAGRLRDIVTYYPSSADTITAELCSLLQLPPQCVAMGNGSTELITWIDHLLVRESLAVPVPTFGRWTDQPMETGKRVDMFPLQEAGGFALDLARYGEFVRARGTRAVVVCNPNNPDGGYLHKQALVQFMDAMADRDLVVIDESFLEFADAEAEPSVVQEAMLRPNVVVLRSLGKNFGLHGIRFGYLVANPALAGRVRAMLPKWNLNSFAEHVVFMLRDHGPEYARSLHQVRRDRLEMAAQLSALPGLTVYPSQGNFLFVRLPVGAEGTAVRDRMLTEHRVLVRECGNKIGSSSRFLRLVVRPQADVRRLVSGLEQVLYGAGRGAAVPGPATGTGYSSGTAAVDRLMYETNGSGMRAITAQAAGAGDPGLAAAPAPATGTGMPLPPAVPVAPAAAAVPGPAPVPQPVPVPQPVPYPGPVPVPHPAPAPQPMPAPAPAPAAAAYPPPFGPTPPGVPARGGLTAAQVRGTNGLESVPATGWPNAAGMGRAG

SEQ ID NO: 8462 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAASSESYGYNEDQIVSSDVVGIEYGSLFDATQTRVMTVGGKQLVKTVAWYDNEMSYTCQLVRTLEYFAGKI

SEQ ID NO: 8463 - protein, 115 aa, Nostoc punctiforme
MTGKGQGFGFGLGKMKELADAFKKAQQVQEGAKRLQEELEQMEILGESGGGLVKVIVSGNQEPKRVEISPDALAEGAEVLSDLVTVAMKEAYNKSTATMRERMEELTSGLELPGF

SEQ ID NO: 8464 - protein, 210 aa, Salmonella typhimurium LT2
MILHPSLASADPLRYAEALTALHDAPLGSLHLDIEDTSFINNITFGMKTIQAVAQYTRHPLSFHLMVSSPQRWLPWLAAIRPGWIFIHAESVQNPPEILADIRAIGAKAGLALNPATPLLPYRYLALQLDALMIMTSEPDGRGQQFIAAMCEKVSQGREHFPAAECWADGGITLRAARLLAAAGAQHLVIGRALFTTANYDVTLSQFTAL

SEQ ID NO: 8465 - protein, 448 aa, Cyanidium caldarium
MGFVLPSTTSYVVYKSSSTIKSKKYNKRNYSSVSRVQVGGSKISSWLSNRLLFQGKEINTTRKTTTKYWIITVSSQTALEEFVNCSGSKGVHESAGISRSKSKVLRNKGIERPVIIGVAADSGCGKSTFLRRVNEIFGTKVSQSHTPQGELVTVICLDDFHTLDRKGRAEKKVTALNPEANNFELMYQQIAALKEGYDIMKPIYNHQTGLIDPPELIQPNHIIVIEGLHPWYDARMKQLLDFTVYLDISDEVKVAWKIQRDMAERGHKLENILASIESRKPDFQQYIDPQKKDAVAVIQVLPTRLIPDDTEKKVLRVRLIQREGIQGFQSVYLYDEGSTIDWIPCGRKLTCSYPGIKFHYGPDNWYNHDVSVLEVDGNFEKLEELIYIESHLNNTSTKFYGEITQQLLRNSSAPGSNNGTGLFQVLTALKMRQLYEELTGKSIAPVLV

SEQ ID NO: 8466 - protein, 300 aa, Streptomyces avermitilis MA-4680
MTESHPRITKAVIPAAGLGTRFLPATKATPKEMLPVVDKPAIQYVVEEAVSAGLDDVLMITGRNKRPLEDHFDRNYELESALQKKGDASRLAKVQESSDLATMHYVRQGDPKGLGHAVLCAAPHVGREPFAVLLGDDLIDPRDPLLARMVEVQEQRGGSVIALMEVAPEQIHLYGCAAVEATDEGDLVKVTDLVEKPDPADAPSNYAIIGRYVLDPHIFDILRKTEPGRGGEIQITDALQQLAADEKVGGPVHGVVFKGRRYDTGDRGDYLRAIVRLACEREDLGPEFRTWLRSYVAEEM

SEQ ID NO: 8467 - protein, 420 aa, Oryza sativa
MDPSAAAAAADDDDDYHATTGGMEPRGEEDNGASTRGVTGRLLAWRGEEEDDDDAEDSGGGSGAGANADEDDAASAVSLDTISNDSILLPPEPTSANLASLLRARKLILVVDLDHTLINSTRFAHLSDDEKANGFTERTGDDRSRGLFRMGLFRMITKLRPFVHEFLREASAMFEMHVYTLGNRNYATAVAKLLDPDGAYFGERIISSGESSQPDRKSLGDVFGWAPEMERAAVVILDDTAEVWKGYRDNLIEMERYLYFASSRGKFGIAVRSLAERNRDESEREGALAVALRVLRRVHGEFFSGSVCSGSFADVREVIRQARREVLRGCTVAFTGVIPSGDGGRASDHPVWRRAEQLGATCADDVGEGVTHFVAGKPVTRKALWAQTHGKFLVDTEWINAAHFRWSKPEERMYPVKGEH

SEQ ID NO: 8468 - protein, 539 aa, Triticum aestivum
  unsure (1)..(539): unsure at all Xaa locations
MARSEQQGLQVLSALDAAKTQWYHFTAIVVAGMGFFTDAYDLFCISLVTKLLGRIYYTGLRPPAPGTLPPGVAAAXNGVAFCGTLAGQLFFGWLGDKMGRKSVYGMTLILMVICSIGSGLSFAHTPGSVMATLCFFRFWLGFGIGGDYPLSATIMSEYANKKTRGGFIAAVFAMQGFGILTGGVVTLIVSAAFRAAFPTQAYQDAPLASTPAQADFVWRFILMFGAVPALMTYYWRMKMPETARYTALVAKNAKQAAADMSKVLQVDIGAEEEDPKANDGGAGAADDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYGLTFFFANFGPNSTTFIVPAEIFPARLRSTCHGISAAAGKLGAIVGSFGFLYLAQNQDPAKVDHGYKAGXIGVRNSLFILAACNFLGMGFTFCAPESNGLSLEELSRENEEEAPDARTVPV

SEQ ID NO: 8469 - protein, 151 aa, Zea mays
  unsure (1)..(151): unsure at all Xaa locations
MDVEGKMNLEIGSKDMEVESKNLKLEDPLPSSAMDMDEPAVAESGEVDGSNGSSKECPLTPRDSMTSNVPVAKEPRSVSTDFGDELDLELGSGEPEPGRQQERKLSRQDRLELSRLFQHAVSAHDXECADGLLATADAQGLNDXLCVAVDA

SEQ ID NO: 8470 - protein, 427 aa, Methanopyrus kandleri AV19 [sequence omitted]

SEQ ID NO: 8471 - protein, 376 aa, Brassica napus
MGWIPCSGKSSGKTKKRSDSDENLSRNCSVSASERSKAKSSVSESRSRGSDNIVAQTFTFSELATATRNFRKECLIGEGGFGRVYKGYLASTGQTAAIKQLDHNGLQGNREFLVEVLMLSLLHHPNLVNLIGYCADGDQRLLVYEYMPLGSLEDHLHDISPSKQPLDWNTRMKIAAGAAKGLEYLHDKTMPPVIYRDLKCSNILLGDDYFPKLSDFGLAKLGPVGDKSHVSTRVMGTYGYCAPEYAMTGQLTLKSDVYSFGVVLLEIITGRKAIDNSRCTGEQNLVAWARPLFKDRRKFSQMADPMIQGQYPPRGLYQALAVAAMCVQEQPNLRPVIADVVTALTYLASQRFDPMSQPVQGSLFGPGTPPRSKRVV

SEQ ID NO: 8472 - protein, 616 aa, Arabidopsis thaliana
MGCLRSLVRRKQFDSSNGKAETHHHHQQLAKALTFPHLIAIGVGSTIGAGVYILVGTVAREHSGPALALSFLIAGISAALSAFCYAELSSRFPSAGSAYHYSYICIGEGVAWLIGWALILEYTIGGSTVARGISPNLAMIFGGEDCLPTILARHQIPGLDIVVDPCAAVLVFIVTGLCCLGVKESTFAQGIVTTANVFVMIFVIVAGSYLCFKTGWVGYELPTGYFPYGVDGMLTGSATVFFAYIGFDTVASMAEEVKNPRRDLPLGIGISLLLCCLLYMMVSVVIVGLVPYYAMDPDTPISSAFSSHGIQWAAYLINLGAVMALCSALMGSILPQPRILMAMARDGLLPSYFSYVNQRTQVPINGTITTGVCAAILAFFMDVSQLAGMVSVGTLVAFTMVAISLLIVRYVVPPDEVLIRLELVPLPSSLQENSSSHVGTSIRSKQPLLGKVDDSVVDKENAPGSWVLNKKNRRKFAGWSIMFTCIGNFLLSYAASSFLLPGLLRYSLCGVGGLFLLVGLIVLICIDQDDARHSFGHSGGFICPFVPLLPIVCILINMYLLVNLGAATWVRVSVWLFLGVVVYIFYGRRNSSLVNAVYVSTAHLQEIRRTSGHSLA

SEQ ID NO: 8473 - protein, 157 aa, Glycine max
MASLHSLAAVSVIATKGTAVTSSCSSTLRPLSSLRFKPRELSIFPNHRKGKGGAIKAQSKEASLPPPTVGEGDALTSMKHLLLPVIDRNPYLSEGTRQAAATTTSLATKYGADITVVVIDEEKRESSSEHETQVSNIRWHLAEGGFEEFKLLERLGE

SEQ ID NO: 8474 - protein, 175 aa, Bradyrhizobium japonicum USDA 110
MANETKLPVTKKTNEPAFGGETWRPFEALRKEVDRLFEDFGTDDFWRRPFRSLAGFERNLAQKLVSTPAVDVTESDKAYEITAELPGMDEKDIEVNVANDGLTIKGEKKFEREEKQKDYYVSERRYGSFERHFGLPKDVEADKIEASFRNGVLKVTLPKTAEAQKPAKKIEVKAA

SEQ ID NO: 8475 - protein, 453 aa, Staphylococcus aureus subsp. aureus Mu50
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 8476 - protein, 202 aa, Glycine max
  unsure (1)..(202): unsure at all Xaa locations
MADQGLEGSQPVDLQKHPSGIVPTLHNFVFIANIKXNFKKKKKKKKKNRNAEYNPKXRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 8477 - protein, 297 aa, Yersinia enterocolitica (type 0:9)
MTKLKAVIPVAGLGMRMLPATKAIPKEMLPIVDKPLIQYVVNECVAAGIKEIILITHSSKNAVENHFDTSYELEAMLEARVKRQLLDEVQSICPPGVTIMHIRQGHAEGLGHAVLCAKPLVGNEPFAVLLPDVLIDDAKSDLTKDNLAQLVKRFDETGVSQVLVHSVEPEALSNYSVISCEKSDLAPGESSRIKAMVEKPQSPVDLQSNLSAVGRYVLSADIWPLLEQTKPGAWGRIQLTDAIDALTENAPVDAVALTGQSYNCGEKLGYMQAYVAYGLRHPKQGAEFKAWLKKYIN

SEQ ID NO: 8478 - protein, 231 aa, Staphylococcus aureus subsp. aureus Mu50
MTVLTDKIAVVTGAGSGIGEAIATLLHEEGAKVVLAGRNKDKLQNVANQLAQDSVKVVPTDVTNKEEVDELMKIAQQTFGGLDIVINSAGQMLSSKITDYQVDEWDSMIDVNIKGTLYTAQAALPTMLEQSSGHLINIASISGFEVTKSSTIYSATKAAVHTITQGLEKELAKTGVKVTSISPGMVDTAITAAYNPSDRKKLDPQDIAEAVLYALTQPKHVNVNEITVRPV

SEQ ID NO: 8479 - protein, 476 aa, Pseudomonas putida KT2440
MTTSHYIAGHWVEGQGSDCISVNDPALGQPFAELMAASVSQVDQAVAAARSALPAWKSTCASERAAFLRGFAEQLGQRREALVTVQMRNNGKPRHEAEIDLDDAIATFGYYAELAEQLPSKNRTVPLAAPGFTARTRLEPVGVVGLIVPWNFPLVTSAWKLAPALAAGCTVVLKPSEVTPLIEQAYGQIADALGLPAGVLNIVNGKAETGAALSNHNGLDKLSFTGSNSVGSQVMRSASAQCRPVTLELGGKSAIVVFDDCDVDQAVEWIVAGISWNAGQMCSATSRLLVQDGIADALLPRLQAALENLRVGNPLTEEVDMGPLTSQAQWLKVASYFATAREEGLQCLAGGHALDREGWFVSPTLYTDVPKDSRLWTEEIFGPVLCARRFATEEQAIAEANDSRFGLVATVCSADLERAERVADALEVGHVWINSVQAVFVETSWGGTKGSGIGRELGPWGLSAYQSIKHVTRCLG

SEQ ID NO: 8480 - protein, 422 aa, Glycine max; identical to SEQ ID NO: 3081
  unsure (1)..(422): unsure at all Xaa locations

SEQ ID NO: 8481 - protein, 339 aa, Geobacillus stearothermophilus
MKAAVVNEFKKALEIKEVERPKLEEGEVLVKIEACGVCHTDLHAAHGDWPIKPKLPLIPGHEGVGIVVEVAKGVKSIKVGDRVGIPWLYSACGECEYCLTGQETLCPHQLNGGYSVDGGYAEYCKAPADYVAKIPDNLDPVEVAPILCAGVTTYKALKVSGARPGEWVAIYGIGGLGHIALQYAKAMGLNVVAVDISDEKSKLAKDLGADIAINGLKEDPVKAIHDQVGGVHAAISVAVNKKAFEQAYQSVKRGGTLVVVGLPNADLPIPIFDTVLNGVSVKGSIVGTRKDMQEALDFAARGKVRPIVETAELEEINEVFERMEKGKINGRIVLKLKED

SEQ ID NO: 8482 - protein, 371 aa, Listeria monocytogenes EGD-e
MASKTKKAIIDVKKQFEAVHKQFELVQILNEKGEIVNPDLMPDLTDDQLVELMTRMVWTRVLDQRSISLNRQGRLGFYAPTAGQEASQLASHYALEKHDYILPGYRDVPQLIWHGLPLTKAFLFSRGHFVGNQFPEDLNVLSPQIIIGAQIVQAAGVALGLKKRKKDAVVITYTGDGGSSQGDFYEGMNFAGAYHAPAIFVVQNNKFAISTPREKQSAAETLAQKAVAAGIPGVQVDGMDPLAVYAVTKFARERAVAGEGPTLIETMTYRYGPHTLSGDDPTRYRTKELDGEWELKDPIVRFRTFLEGKGLWNEEKENAVIDQAKEEIKVAIKEADATPKQTVTDLLKNMYETPTAPIKEQLAIYEAKESK

SEQ ID NO: 8483 - protein, 448 aa, Streptococcus agalactiae NEM316
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMEHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 8484 - protein, 340 aa, Cordyceps bassiana
MSRANPPNNASASRKISFNVSEQYDIQDVVGEGAYGVVCSAIHKPSGQKVAIKKITPFDHSMFCLRTLREMKLLRYFNHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDN

SEQ ID NO: 8485 - protein, 226 aa, Zea mays
MGVAVAEAGGEVVAQGNATEAKEGSLADMIDRALEKEFPESEGEQGGGETDPGSFNNTVAEKQGVLETVARRVTKKNETKDNKSFPFKEVFLDRTEQEDVPTLIDRKDNVFIISNPKSKYPVLQLDLRLISDLVVVIVSATCGGIAFACLGQPVITGYLLAGSIIGPGGFSFVNEMVQVEIAWCDISLLGTCSGAVFESSVSRMIGGVSGCRPQMRVSCNIRMYDG

SEQ ID NO: 8486 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 8487 - protein, 375 aa, Methanosarcina acetivorans C2A
MRKLRIRIEVKSYKVNKRCINMAENIQSKGYAGKDESGKLVPWSFERRPVGNNDILIDIKYCGVCHSDIHQIKGHWGPQQYPQVPGHEIVGVVAAVGKNVTNFKVGDRAGVGCMVSSCMECESCKNGEEHHCDNNATIMTYGYLEESSPTGISQGGYSQNIVVAEHFAIKIPDSIDLQEAAPLLCAGITIYSPLMKANIKKGDKVGVAGIGGLGHMAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIRMIEPEMINETWDKVVNKEARYRYVIDMSSLK

SEQ ID NO: 8488 - protein, 698 aa, Leuconostoc mesenteroides subsp. mesenteroides ATCC 8293
MAILELIVILIVAVTISNIVSHFIPEIPISLFQIAIGLFLALVCGIYVEVDSEWFMLLFIAPLLFNDAWRFPKHELWELRGPILGNSIILVILTTLVGGFLMHLLMPQLPKSVALALAAVISPTDPVAVQAIARRVKLPENVMHIVSGESLINDASGLVSFNTAIKATIAGTFLIGEAIGNFFWMTIVGLAVGLILGSFVSWLRDSFDRVGLNDVVFHTVVTLLMPFVIYWVAEDIFHSSGVIAVVAGGVLSKILSDQHMNARSPEINVVTVRTWEVFVYLLNGTIFILLGIELPAAMKDIVRSTQVHTGMAIFYGVAVWFIIFTIRTFWAYGTQITYHLKHKERAISFRMAIISGLTGVRGAVTMAAVLTVPSTIADGSAFPQRNLLVFVAAVVVIISLLVATIMLPIVTKQRTTHDFTQPEVGEVETSSTHESKVDLTEAQARIFSIRIGIQVLREQQNDHNRIIVYELIGRKQQIIDQIYRQLNKSNDHKVNIEDDRELRRVALEAQRNCLRQLLADEKISILTYSSQNRRLDRLENMIDSDKHYHLSTQWIIILWRRTLRSIRIWISDESTDQFREESSMATKEMAKEAIQSLSEYMEKYTGDTVSHRMERQAAYNLIIFYRNQIEKERHPDTPEQRELDDRYRMELEIKALNVERETIQQLYEQGRISRQAGVNIRQFINYAETAALAGRDEE

SEQ ID NO: 8489 - protein, 162 aa, Rhodospirillum rubrum
ESLHMALWIMSDRTIPRSFRFMEGFGVHTFRLVTAEGKSSFVKFHWKPKLGLQSVVWNEAVKINGADPDFHRRDLWSAIKRGDYPEWDLGLQVFDDAFADSFPFDVLDATKLIPEELVPIRIVGRLVLDRTVDNFFAETEQVAFHTANIVPGIDFTNDPLLQ

SEQ ID NO: 8490 - protein, 186 aa, Zea mays
  unsure (1)..(186): unsure at all Xaa locations
MSILRIHAREIFDSRGNPTVEVDLYTAKGLFRAAVPSGASTGIYEALELRDNDKTRFMGKGVSQAVEHINKTIAPALVSKKVNVVEQEKIDKLMIEMDGTENKSKFGANAILGVSLAVCKAGAVEKGVPLYRHIADLAGNPEVILPVPAFNVINGGSHXAGNKLAMQEVMILPVXAXSFREAMRIG

SEQ ID NO: 8491 - protein, 281 aa, Saccharomyces cerevisiae
MSNHSEILERPETPYDITYRVGVAENKNSKFRRTMEDVHTYVKNFASRLDWGYFAVFDGHAGIQASKWCGKHLHTIIEQNILADETRDVRDVLNDSFLAIDEEINTKLVGNSGCTAAVCVLRWELPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 8492 - protein, 392 aa, Triticum aestivum
  unsure (1)..(392): unsure at all Xaa locations
RPPTRPVLPLPQVVILIILPPLQGSQFMKAKNILMLIVICQYVPRLIRIRPLYLQITRSAGIITETAWAGAAFNLIIYMLASHCCXVLGAVWYLLSIQRKDACWKHECSLKTGCKAAYLYCGNGDTNAGNAFLQNGCIPSTPADNLPDPLFGIYLPAINNVSQSTNFFAKLFYCVWWGLQNLSSLGQNLKTSTYAWENLFAVFVSISGLVLFSLLIGNMQTYLQSATLRIEETRVKSRDTDQWMSYRLLPDNLKERIRRYEQYRWQETSGVDEEHLLMNLPKDLRRAIKRHLCLSLLKRVPMFEKMDDQLLNALCDCLKPVLYTEGGYIVREGDPVNEMIFITRGNLMSMTTNGGKTGFFNSDVLKSGDFCGEELLTWALDPNSSSSLPSLT

SEQ ID NO: 8493 - protein, 328 aa, Burkholderia fungorum
MRAMVFDGSSALLREQEVPDPKPGPGQLLIQIHACGVCRTDLHLVDHELEHPKQPVIPGHEIVGTVAGLGAGVTGFAVGDRVGVPWLGHTCGHCRYCLSARENLCDEPGFTGYTIDGGYAERTVADSQYCFHLPAQYPDIEAAPLLCAGLIGYRTLKMAGDAQRIGIYGFGAAAHIVAQVALHQKRTVYAFTRPGDHAAQQLALRLGAAWAGGSDEAPPAELDAALIFAPVGALVPQALRAVAKGGTVVCGGIHMSDIPSFPYAFLWGERRVVSIANLTREDGLAFMRIATERRLEIDTTTYALTDANRALSDLRDGRLTGAAVLVVR

SEQ ID NO: 8494 - protein, 286 aa, Bacillus subtilis
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPDKK

SEQ ID NO: 8495 - protein, 858 aa, Rhodospirillum rubrum
MVLSHRARGLAVYVSRPRFSLSLPPPTTRILIMDTVIRTDFELDEGIDFTDVEQIKHGLVTSMVRGVGFDPASATEHDWFLALASLLRGHLSEKGMMTSRAQYGSDTKRVYYLSLEFLTGRRLVKHLLDLGIESAVRAALRELGQDLDRVAEQESDAALGNGGLGRLAACFLDSMATHGYPGYGYGIRYEFGMFSQTIENGQQVEHPESWLRNGNPWEIVRHNVSYPVRFGGHIVCFRDEGGEERCRWVDANEVIAEAYDLKETGYGGAYGCNLRLWSARATQDFDLSYFNEGNYIEAVKDKTTSENLSKVLYPMDTTLMGQELRLKQEYFFVSASLQDILARFFKVHKDPKQIPAKIVIQLNDTHPALAVPEMMRLLMDNHALSWDAAWDITRDTFAYTNHTLLPEALETWPVAMLEAILPRHLEIIYKINYGFLQQVRRAFPGDVAMLRRMSLIDEDTHRVRMAHLAVVGSRRVNGVAALHTKLLRERVFPDFDAFFPEKFVNVTNGITQRRWLLQSNPPLAALVSETIGEGWLTDLDRLRDLEKLADDPAFQDRFLTIKAGAKARAAALIAERCGVVVSTASLFDIQIKRIHEYKRQLLNIMQVIARYNAIRRDPKAVMTPRTVIFGGKAAPGYYVAKKIIRLINDVAETINHDPAVRDLLKVVFVPNYNVSTAEILIPSCDLSEQISTAGTEASGTGNMKFALNGALTIGTLDGANIEIREEVGDDNIFIFGHTAQEVSQIKAQGYDPWSWYAADDEMRTVIDMIRDGFFSTEEPDRYRPIADALLGSDTYLVLADFRSYMDAQKAVDGLYTNQRVWARQAILNIARVGKFSSDRAIHTYAKDIWGVRPMDALS

SEQ ID NO: 8496 - protein, 132 aa, Trichodesmium erythraeum IMS101
MVNKIKKSEKEWKEQLTPEQFNVTRKKGTERPFTGEYYNNKEKGIYKCVCCGIDLFSSEAKYDSGTGWPSYWKPINQENIKEETDWSLFMRRTEVLCNNCDAHLGHVFPDGPPPTGLRYCLNSAALKFSKGE

SEQ ID NO: 8497 - protein, 452 aa, Oryza sativa
MVVQPPSVWAYACPNHRTFSSLSPFCSRNPPAAASGGGARSSSSSSLRFVSSGARRSKNCWGGSEVDAVGEPSCMDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 8498 - protein, 446 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 8499 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSLSSLPAVVEPCFSAGDDWMDDVRALASFLDTDDAWNLCA

SEQ ID NO: 8500 - protein, 388 aa, Zea mays
  unsure (1)..(388): unsure at all Xaa locations
ITQFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQAAADGAVRVKRRKGPRRGEDFTLMQALIKAXGFWLLFFSLLLGSGSGLTVIDNLGQMSQSLGYEETHIFVSMISIWNFLGRIGGGYFSEIIVKDYAYPRAIALAIAQVLMAIGHFNFAMAWPGTMYIGTLLVGVGYGAHWAIVPAAASELFGVKNFGALYNFLTVANPAGSLVFSGVIASGIYDSEAAKQAQQRHNSTSLAMSGRVAGMVSGAAPSLKCEGAVCFFLSSLIMSGFCIIAFGLSLILVYRTKIVYTSLYGKPRT

SEQ ID NO: 8501 - protein, 140 aa, Zea mays
LRASSRRTSRGGILFRLRAGSRRTSRGRNRMPLPKSIAAPPGSIPLPPEQDTLLAQNYQLLPPLKPPPQYEETEDENGEPNPSNPANSNPSYSQDQSNKEQQQQHTPQHGQKVSFQLNAVAAAAAAAKRPRMTIDQLNMG

SEQ ID NO: 8502 - protein, 424 aa, GIBBERELLA ZEAE PH-1
MALACAGMVSAQTFTDCNPLKKTCPADPAFGDTKVECDFAKGECSAFHNMIATELKYTEQGALFRINKETEAPTIRSDNYLFFGRVDVVVQAAKGQGIVTSAVLQSDDLDEVDWEWVGGDDAQVQSNYFSKGDTSTYDRAQYHPVSAPLSTTHKYSVEWTSTKIDWLIDDVVVRTLNAADAKGAAGFPQTPMQVKMGTWVAGGKNSNEGTREWAGGYTDFKQAPFDAYYRSVTIVDYAGKDAPGQNPGAKEYLWTDKSGDWESIDVKKTLSDTETSASTTVTKATKTAEPTKTKTAEHTSTVEETTSAVVTKTKTAEHESKTHETQTESAKETKTTEAATTFSTATAVASTTVVSDEAAATSTGGASSGPDSGVNSGAAVDRGSSSDSADSAPSDTPVAVNSGSRMAGSLITAFAGLMLAQIII

SEQ ID NO: 8503 - protein, 462 aa, Oryza sativa (japonica cultivar-group)
MENNMQAARTATTRERAPPRATAISRYIFLALARIPVNKCVAWRSAGALLLLVTDMAAMASAAAEVPSYFVCPISLQLMRDPVTLPTGISYDRAAIARWLAAPGARRTCPVTRQPLEHGLELTPNHTLRRLIQSWAASVSPGSAVDEEVAALRPVSSDEVASLLSDAAAAQVGALRRLRELAAECEDSRAMLESQGGVFDVLSRVVTSGSACSTAREEAVGVLASLRIPEQELIGVSTRHGNLAESLTAVLRSSNLQSRAHAVQLVRTLADAVVPAWVIGLNAELLAEVVGVVRDRVSARATKASLHALAALCPYGRHRVKIVGAGAVAALVELLLDEPERRVCELALAVLDRLCTCAEGRAELVAHAAGVAVVGKKVLRVSEAASERAVRVLRSVARHAATPAVLQEMAQCGVVGKLCLALRSEQCGVKTKEKAHEVLKLHSRVWRASPCLSPSFLALYPS

SEQ ID NO: 8504 - protein, 234 aa, Pachysandra terminalis
  unsure (1)..(234): unsure at all Xaa locations
VQLRRMENKINRQVTFSKRRTGLLKKAHEISVLCDAEVALIVFSTKGKLSQYSSNSSMETILDRYERYSYAERKLMAGDHLDSQGSWPLEYTKLKSKIEVLQRNQRHFMGEELDSLSLKELQYMEHQLDTSLKHIRSRKNQLMNDSIYDLQKKEKALQEQNSTLIKKLKEKEKAPAHQACWEQQGQNLPSFLLSQPLPSLNIGXNYXLARXSRDEEEGAQSHARTNPIMPPWML

SEQ ID NO: 8505 - protein, 591 aa, Streptococcus pneumoniae R6
MTQGKITASAAMLNVLKTWGVDTIYGIPSGTLSSLMDALAEDKDIRFLQVRHEETGALAAVMQAKFGGSIGVAVGSGGPGATHLINGVYDAAMDDTPFLAILGSRPVNELNMDAFQELNQNPMYNGIAVYNKRVAYAEQLPKVIDEACRAAISKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFAFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSIDVGNTTQTSTRHLHMTPKNMWRTSPLFATMGIALPGGIAAKKDNPDRQVWNIMGDGAFNMCYPDVITNVQYDLPVINLVFSNAEYGFIKNKYEDTNKHLFGVDFTNADYAKIAEAQGAVGFTVDRIEDIDAVVAEAVKLNKEGKTVVIDARITQHRPLPVEVLELDPKLHSEEAIKAFKEKYEAEELVPFRLFLEEEGLQSRAIK

SEQ ID NO: 8506 - protein, 348 aa, Saccharomyces cerevisiae
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 8507 - protein, 198 aa, Triticum aestivum
MTAPRRWRFAMVCSSNMNRSMEAHAVLGRAALDVESYGTGSQVKLPGPSMHEPNVYDFGTPYGGIYDDLRRKDPDLYKRNGLLPMLKRNISVKLAPQRWQDNAGDGVFDMILTFEERVFDLVVEDMNNREQRLLKSVLIINMDVKDNHEEAAIGAKLALDLCHKLEAVAGDWEEIIDDLIAAFEKQHKRKLTYYISFY

SEQ ID NO: 8508 - protein, 521 aa, Oryza sativa (japonica cultivar-group)
MSRSVQLAVAAGDQVDPDSLRLHQLGYKQELKRGLSALSNFAFSFANISVMMGVTTTYNTGLRYGGPVSMTLGWLVVAVFNCCVALSMAEICSAYPTSGGLYYWSAKLAGKQWASLASWVTGWFNVVGQWAAIASVDFSLAQLLQVIILLSTGGGNGGGYMASKYTVLAIYAFILILHGIINSLPIEWLSLFGHVGAIWNAAGIFVLTILIPAVAKDRPNIEFVFTHLNTENGMGIHDKAYILAVGLLMSQYSVIGYDTSAHMVEETKNADRSGPIGIITSVLFATVFGWIYLLALTSVVTDIPYLLSPSNDAGGYAIAQALYTAFHRRYGSGVGGIVCLGAVAVAVFLCGIACVTSNSRMAYAFSRDGAMPLSRVWYRVNKHEVPLNVVWLGVAVAFVMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVGAWVLRARFWFQGPITNVDTHC

SEQ ID NO: 8509 - protein, 491 aa, Xanthomonas axonopodis pv. citri str. 306
MRSDPTSPGVRMKTALFAGWKARFYSVCMLMLFSALMVGGMGSAHAQSTPQVTPLPTEPVTTEPLPSAQPAAPPAAAAEAAPVVEKGDVAWMLTSTLLVLLMVVPGLALFYGGMVRAKNVLSVLIQVAVVFSLLTVLWVFYGYSLAFSGEGAWIGNLDKALLKGVTIETLAATFTKGVSLPEYVFVAFQATFAGITGALIVGAFAERAKFAAVLLFSAIWFTFGYLPLAHMVWATGGYLFGLGALDFAGGTVVHINAGVAGLVGAYFVGKRAGLGREAIKPHNVTLTFVGASLLWVGWFGFNAGSNLEANAGAALAFLNTLLATAAAILGWSLTEKIIKGKSSALGVASGMVAGLVGITPACGTVGPFGAIVIGLAAGVLCVWGVTGLKRLLGADDSLDVFGVHGLGGIIGAILTGVFSAASLGGQKGGDYDIVHQVGIQALGVGITVGWIGVVSVVGFVVAKLVFGLRVSEEAEREGLDITSHGEAAYES

SEQ ID NO: 8510 - protein, 218 aa, Brassica napus
MKTFFLVTLLLAAAVCTHGREQVKDSNGNPVKRGAKYFIQPAKSNAGGLVPAAINLLPFCPLGITQTLLPYQPGLPVSFGYEPVIVGTDYIYTSTTINIEFESDIWPVCNELSKLWAVDVSSSAAKEPAIIIGGESTAPNSLFKIEEATEANTYKLTTSYGTVGTIPGPWLSAPQLIVTNDESKTLFVKFVKVDDAATKATTSTSRVEKLGLKMFPFY

SEQ ID NO: 8511 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTL

SEQ ID NO: 8512 - protein, 399 aa, Candida tropicalis
MMNIDQHHQQLQQQSQAQAQAQAQAQAQAQAQAQAQAQAQAAAAAVAASSQRQVSFNVSDHYQILEIVGEGAYGIVCSAIHKPSNQKVAIKKIEPFERSMLCLRTLRELKLLKHFNHENIISILAIQRPLNFESFNEIYLIQELMETDLHRVIRTQNLTDDHIQYFIYQTLRALKAMHSANVLHRDLKPSNLLLNSNCDLKVCDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFQELFSNKPGINPLALDLLEKLLIFNPAKRITVEDALKHPYLQLYHDPNDEPISDKIPEDFFDFDKKKDSLTIEDLKKMLYEEIMKPL

SEQ ID NO: 8513 - protein, 340 aa, Glycine max
MASDKKIRIGINGFGRIGRLVARVALQRNDVELVAVNDPFITTDYMTYMFKYDTVHGQWKHFDVKLKDSKTLLFGEKPVTVFGFRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKAAIKEESEGKLKGILGYTEDDVVSTDFVGDNRSSIFDAKAGISLNENFVKLVSWYDNEWGYSSRVIDLIAHIASVA

SEQ ID NO: 8514 - protein, 54 aa, Glycine max
MADSVISIQYLKDFVNSQIYDDEKWAFNAKLLRAAGLFAGSILLMRNYGDLMAI

SEQ ID NO: 8515 - protein, 318 aa, Methanosarcina acetivorans C2A
MKSISTQCKNKFLRNFSFYGELTVTIKKALIPAAGLGTRFLPATKSMPKEMLPIIDTPVIQYVVEEAIASGIEDIIIITGRGKRAIEDYFDDSPELEMHLAKKNQTDMLKLVRDISSLVDIHYIRQKEPNGLGDAVLRAENHIGNEPFAVLLGDDIIVNDKPCTAQLIENFEKYGRSTIAVEEVPYEKLNSYGIIKGRPLDDSLYVLEDIVEKPSPEEAPSNIGAIGRYVFTPEIFDCIKKAGTGVGSEIQLTDGIRLLSRSQMIYACRFKGKRFDTGDRLGYIKSIIDFALQNESLRDNVLEYLREILAVEKVTAEK

SEQ ID NO: 8516 - protein, 223 aa, Zea mays
SATFSVKVGLSQMLRGGVIMDVVTPEQARLAEDAGACAVMALERLPADIRAQGGVARMSDPALIRDIKSAVTIPVMAKGRIWHFVKAQILEAVGAVMIRTKVEADTNNVVQAVRHVRSVRAAAVSPAAAFSLMDVDEGDADARTAVVVILAALGCSSAATASCVGSGIFKSGDPARRARAIVQAVTHYSDPTILTDVSAGLGEAMVGINLNDPKVERYAARSE

SEQ ID NO: 8517 - protein, 173 aa, Triticum aestivum
DSATGGSKDSRVRTSSGTFLKRGQDKIVRTIEKRISDFTFIPVENGEGLQVLHYEVGQKYEPHFDYFHDDFNTKNGGQRIATVLMYLSGVEEGGETVFPSAKVNSSSIPFHNELSECAKRGISVKPKMGDALLFWSMRPDGTLDPPSLHGGCPVIKGDKWSFTKWICVHEYKV

SEQ ID NO: 8518 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVAECACLIGLPKFKDFYKLNGKPVYILVESRK

SEQ ID NO: 8519 - protein, 205 aa, Glycine max
IPLWNRRDSSTQTSVLHNLVVGTPVISATYDQLQKSARYLPGPATQCQYSTTTSKQMRLGTNISETVKRKLSLGAHILRVGGVEKVFKQFFSVEDGEKLLKVSQCYLSTTSGPLAGFLFISTDKVAFCSERSMKIFSQKGHMLRIRYKVVIPLNKIKCVNQSENVQKPTQKYIEIVTEDNFDFWFMGVLKYQKTFKYLEQAVSQA

SEQ ID NO: 8520 - protein, 206 aa, Zea mays
  unsure (1)..(206): unsure at all Xaa locations
MSVQEYLGKHLLSRKSEEALNTAVRAKAPNPALFIVGHMRREAPTVITRVRARQILDGRSAPAVEVELHTNKAVHRASTASVGALEGAAADAAGASERRKFLARGVAYAVRVINDKVSEALVGMDPQQQTQIDQAIMXLDRARHKAEFGANTMLGVSIAACKAGAAEKEVPLYKHIADLVGKSATTLRVPAITVINGGRAHEDTRI

SEQ ID NO: 8521 - protein, 574 aa, Escherichia coli O157:H7 EDL933
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDRDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 8522 - protein, 507 aa, Musa acuminata
MALPPLLLSPLPSLLVVLALLSSLLLAGRKARGGSATWKLPPGPPKLPVIGHLHLLGSSLLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVTVHREYALCLMATKYDATTA

SEQ ID NO: 8523 - protein, 162 aa, Corynebacterium glutamicum ATCC 13032
MPAQNKNLPGSVIVVSDRIKSGERIDKAGPVAVDLLQESGVEISTFTVVEEGFEPVHQELVKALARRDRVIITIGGTGVGPRNRTPEATEPHIDTLLPGLMTQILFSGLSNTAQAGLSRGLVGLSARDSTAALIVNAPSSSGGVRDALGVVCPLFGSIFERL

SEQ ID NO: 8524 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 8525 - protein, 199 aa, Triticum aestivum
  unsure (1)..(199): unsure at all Xaa locations
EQEVILSEGDEQKPKEIDLLPASERQKRIAELQAKLFQAAAVGAVRVKRRKGPRLGEDFTCXQAMIKADFWLLFFSLLLGSGSGLTVIDNLGQMSQSLGFEDSHIFVSMISIWNFLGRISGGFFSEIIVKDYAYPRAIALATAQVFMAIGHFIFAMGWLGKMYIGTLLIGLGYCTHWAIVPAAASELFGVKNFGAVYNF

SEQ ID NO: 8526 - protein, 122 aa, Yersinia mollaretii
WKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGG

SEQ ID NO: 8527 - protein, 328 aa, Pseudomonas aeruginosa PAO1
MLPVKNLFVLYTGGTIGMLQTPQGLAPAGGFEARMRDHLQSLGDAPDLRWRFAELQPPLDSANMTQGNWLAMRDAIVAALDAGHDGVLLLHGTDTLAYSAAALSFLLLDLPIPVLLTGSMLPAGAPGSDAWDNLVGALRVLQEGHARGVQVYFNDALLHGARVSKLRSDAFDAFAELPRPRHAEHAPVPAALGYRQPRREVNLAVLPLYPGLRAAHLRGLLDSGVEALLLECYGSGTGPSDDEELLALLREAHARGVLLAAVSQCAYGQVEFGVYAAGSRLRDAGLLSAGGMTREAALGKLFGLLGAGLGRDEAQRWFALDLCGENAD

SEQ ID NO: 8528 - protein, 584 aa, Desulfonispora thiosulfatigenes
MAKVKMTPSEAMTEVLVNEGVTHVTGILGSAFMDMLDLWPTAGIEFIAVRHEQTAGHMQDAYCRITGKASVCIGQNGPGVTNLVTCVAAANQAHTPMVVLGPSAGTPTVGWDGFQECDQVSIFRSITKQVLQVPHPSRAGDVLRTAFRIAYAERGPVYVDIPRNYFYGEVYEEILRPDQYRAMNVRGAGDATELARATEILAAAKNPVIISGRGVVDADAFAEVKEIAHMLTAPVAMSYLHNDTYPADDELWVGPIGYMGAKSAMYSLQDADVILAIGSRLSVFGTLPQYDINYFPENAKIIQIEVNPKQIGRRHPVTVPIIGDAKLATAELIKLLKAKGDVKPNAERLAKIQERRNDWFKEIEEMAMMPGNPINPRRVLFEVAKLMPEDAILTTDIGNVASTANSYFKFTKPKKHIAALTFGNTGFAYQAGLGAQMAEPDSPVVAIVGDGAWGQSLHEISTAVQYKLPVIACVFRNMAWCAEKKNQIDFYNNRFVGTEIPNPISFIPAAEAFGAKGIRVEKPEDIADAFKQGLAWRAEGHPVVLEFVVDGTILAPPFRKDALALPTRYLPKYEHLDAKYFPKN

SEQ ID NO: 8529 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 8530 - protein, 140 aa, Glycine max
MNSTEEGMQGIGIGCCSNDVVGQLELSPTMSNSSSSLSMELDESPESRIQRLISEHPVIIFTRSSCCMCHVMKKLLATIGVHPTVIELDDHEIASLPLPDTTAPAAFIGGTCIGGLESLVALHVSGHLIPKLVQVGALWV

SEQ ID NO: 8531 - protein, 223 aa, Bacillus pumilus
MSYRVKRMLMLLVTGLCLSLSTFTAGASAQTGGSSYEPFNNYNTGLWQKADGYSNGNMFNCTWRANNVSMTSLGEMRLSLTSPSYNKFDCGENRSVQTYGYGLYEVSMKPAKNIGIVSSFFTYTGPTDGTPWDEIDIEFLGKDTTKVQFNYYTNGVGNHEKIVNLGFDAANSYHTYASDWQPNSIKWYVDGQLKHTATTQIPQTPGKIMMNLWNGAGVDEWLG

SEQ ID NO: 8532 - protein, 339 aa, Glycine max
MASSNKMKTIKSTFLVLCLLASFLCPIKAHGGSSHDGVSESEDLHSRGLIVVKIWCLIIFLVSTFAGGVSPYFYRWNETFLLLGTQFAGGVFLGTSLMHFLSDSAETFGDLTSKSYPFAYMLASSGYLLTMLGDCVITIVTRNSNREAKVVELEGGTTPQEHDLARDHCAVAETTNPVLLKTSSLGDTILLILALCFHSVFEGIAVGVAGTKADAWRNLWTISLHKIFAAIAMGIALLRMLPKRPFVTTAAYSLAFAVSSPIGVGIGIAIDATTQGSTADWMFAITMGIACGVFIYVAINHLISKGFKPQRTMRYDTPLFRFVAVLSGVAVIAVVMIWD

SEQ ID NO: 8533 - protein, 714 aa, Botryotinia fuckeliana
MYLATVLSLVGLVTAQCPYGMDKQPQKREPKDSQTSSSNFLDQFTLNDTNTYFTTDAGGPIQEDTSLKAGARGPTLLEDFIFRQKIQHFDHERVPERAVHARGAGAHGIFTSYGNYSNITAASFLNQEGKETPVFVRFSTVAESRGSADTARDVHGFATRFYTDEGNFDIVGNNIPVFFIQDAILFPDLIHAVKPSPDNEIPQAATAHDSAWDFFSQQPSSLHTLFWAMAGNGIPRSFRHMDGFGIHTFRLVTDSGTSKLVKWHWKSKQGKASLVWEEAQVLAGKNADFHRKDLWDAIESGNGPEWELGIQIVEEEDVLKFGFDLLDPTKILPEELVPVQKIGVMRLNANPRNYFAETEQVMFQPGHIVRGIDFTDDPLLQGRIFSYLDTQLNRHGGPNFEQLPINRPIVPVHNNNRDGAAHNYIPLNTAAYSPNTLNDAAPKQANQTVGRGFFTAPGRTVSGHLVREVSSTFSDVWSQPRLFYNSLIPVEQQFLINAIRFETSQLTSSVVKSNVLIQLNRVSHDLAARVASVLNLPVPEADNTYYNDNKTSSITIFGNELPTIATLNVGVLVSVKNNATLTQAANLATSFSTSGVNVKVIGEILTNGVDATYSASDATLFDGIIVTDGAENLFTNGSKSTYFPADRPRQILLDAYNWGKPVGTLGNARTSLNVASISTTPGVYSNSTSVSGLVKEFEAGLKTFRFVDRFALDD

SEQ ID NO: 8534 - protein, 144 aa, Lactobacillus plantarum WCFS1
MDKQQGELRQRLTPEQYAVTQEAATERPFSGEYDNFYQEGIYVDVVSGQALFSSRDKYDAGCGWPSFTKPIDQTNLNEHRDESFGMHRTEVTSTQANSHLGHVFPDGPRDRGGLRYCINSAALKFIPVADLEKAGYGQYQSLFK

SEQ ID NO: 8535 - protein, 300 aa, Arabidopsis thaliana
SVSFQLPVIDFSDQNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGR

SEQ ID NO: 8536 - protein, 469 aa, Xylella fastidiosa Temecula1
MSLENVEKLVKDKKIEFVDLRFVDMRGVQQHVTFPVNILEQSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGSVMSDDFINGYIALKMQEVTQFRAATHPLEYQMYYAN

SEQ ID NO: 8537 - protein, 227 aa, Arabidopsis thaliana
ILVDWLVEVSEEYTLASDTLYLTVYLIDWFLHGNYVQRQQLQLLGITCMLIASKYEEISAPRIEEFCFITDNTYTEDQVLEMENQVLKHFSFQIYTPTPKTSLRRFLRAAQASRLSPSLGVEFLASYLTELALIDCHFLKFLPSVVAASAVFLAKWTMDQSTHPWNPTLDHYTTYKPSDLKASVHALQDLQLNTKGCPLSAIRMKYRQEKYKSVAVLTSPKLLDTLF

SEQ ID NO: 8538 - protein, 114 aa, Oryza sativa
MSSTPAAADTAETDQADLKLVKAEPGTGPGLITITVTSQTFADVYFAIKPRVKLRRVMDLYCGKHSLDPKTVKFIDDDGRFVRSEQTPEEVGLQDGSTISLAIDQQGGACICEN

SEQ ID NO: 8539 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 8540 - protein, 355 aa, Streptomyces fradiae
MKALVLAGGSGTRLRPFSYSMPKQLIPIANTPVLVHVLRNLRELGVTEAGVIVGNRGPEISAVLGDGAEFGMRVTYIPQDAPRGLAHTVAITRDFLCDDDFVMYLGDNMLPDGVVDMRGGIHRPSAGGQVVVYKVPDPRSFGVAELGPQGEVLRLVEKPRDPRSDMALVGVYFFTAAIHDAVAAIEPSARGELEITDAIQWLVSSGADVRASQYDGYWKDTGNVEDVLECNRHLLDGLGARMDGTVDAASVLTGEVVIEPGAKVVRSRIMGAAIIGAGTVVQDSHVGPHASIGRRCTVTDSRVENSIALDEASVTGVRGLRNSLIGRSASVGGTGQENERYRLVVGDHTRVEVAA

SEQ ID NO: 8541 - protein, 261 aa, Vicia faba
MASTKDRENFVYIAKLAEQAERYEEMVDSMKNVANLDVELTIEERNLLSVGYKNVIGARRASWRILSSIEQKEESKGNDVNAKRIKEYRHKVETELSNICIDVMRVIDEHLIPSAAAGESTVFYYKMKGDYYRYLAEFKTGNEKKEAGDQSMKAYESATTAAEAELPPTHPIRLGLALNFSVFYYEILNSPERACHLAKQAFDEAISELDTLNEESYKDSTLIMQLLRDNLTLWTSDIPEDGEDSQKANGTAKFGGGDDAE

SEQ ID NO: 8542 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 8543 - protein, 759 aa, Escherichia coli O157:H7
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 8544 - protein, 298 aa, Xanthomonas axonopodis pv. citri str. 306
MSSSHDAAAPARSGLVVLALLLVYVVWGSTYLAIRFALEGGAQPLTMVSGARFIVAGSVLYSALRWRGVAAPTRAQWKNVALMGAALLLLGNGMVVLAERSVSSGLAATAVASVPLWMALFGALRGQHASGGEWLGIVIGFLGVVWLNAGSSLTATPGGLVLLLIAPIGWAFGSVWSRGRDLPSPFMTAAGQMLCGGVLLVSTGLLIGERPQVWPSPQGLLAVAYLCVFGSIVAFTAYVWLLHHVRPALAGSYAYVNPVIAVSLGAWLGHERFSAQDIGAMAVILAGVLVVTFAKARR

SEQ ID NO: 8545 - protein, 58 aa, Synechocystis sp. PCC 6803
MIFPGATVRVTNVDDTYYRFEGLVQRVSDGKAAVLFENGNWDKLVTFRLSELEAVKPI

SEQ ID NO: 8546 - protein, 335 aa, Bradyrhizobium japonicum USDA 110
MAVRVGINGFGRIGRNVLRAIAESGRKDIEVVGINDLGPVETNAHLLRFDSVHGRFPGTVTVDGDSISLGGGKIKVTAERDPSKLPWKDLGVDIALECTGIFTSKDKASAHLTAGAKRVLVSAPADGADATIVYGVNHDTLTKDHLVVSNGSCTTNCLAPVAKVLNDLVGIETGFMTTIHAYTGDQPTLDTMHKDLYRGRAAAMSMIPTSTGAAKAIGLVLPELKGKLDGVAIRVPTPNVSVVDLKIIAKRATDVKEINAAMKRASEQQLKGILGYTNAPNVSIDFNHDPHSSTFHEDQTKVQNGTLVRVMSWYDNEWGFSNRMADTAVAIAKVI

SEQ ID NO: 8547 - protein, 267 aa, Glycine max
  unsure (1)..(267): unsure at all Xaa locations
KRLTSSSNQLAQICACDCFRHRWTGRYEAHLWDKNCWNESQSKKGRQACIYNKNLHYLFPLNWXGWDTILXFPLSNYEEKLKEMEGQSKEEYIGSLRRKSSGFSRGVSKYRGVARHHHNGRWEARIGXGVFCDKYLYLGTYATQEEAAAAYDMAAIEYRGLNAVTNFDLSRYINWPRPKTEENHQTIPSNENVNSNAELELGSASDEITEEGVAPSSESNPSRRTFPEDIQTIFENQDSGIYTENDDIIFGDLGSFGAPIFHYELDV

SEQ ID NO: 8548 - protein, 645 aa, Campylobacter jejuni subsp. jejuni NCTC 11168
MNNNTQNNKGNPQGNNFFNKNPIFIFAIFAIIMIIIFKGFFDGNGSFGGALNGNEVNKNVPYSELKKLIESGQINQVSIGQTTIKAISSSHNTVYTAKKVNDPELVSLLDSKNIAYGAYSETNWFTDILFSWVLPVFIFFGIWMFLASRMQKNMGSSILGIGSSKKLVNSEKPKVKFSDVAGVEEAKEEVKEIVDFLKYPERYIKLGAKIPKGLLLVGPPGTGKTLLAKAVAGEADVPFFSVSGSSFIEMFVGVGASRVRDLFENAKKEAPAIVFIDEIDAIGKSRAASGMMGGNDEREQTLNQLLAEMDGFGTESSPVIVLAATNRPEVLDAALLRPGRFDRQVLVDKPDFKGRCDILKVHMKDVKISPKVKVEDIARLTAGLAGADLANIINEAALLAGRDSKKYVEQNDLVEAVERAIAGLEKKSRRINEKEKKIVTYHECGHALIAETTKGAKRVSKVSVIPRGLAALGYTLNTPEENKFLMQKHELIAEVDVLLGGRAAEEVFIGEISTGASNDLERATDIIKAMISMYGMSEIAGLMVLEKQRNTFLSGGQTIKDYSEKMAESLDDYVKKTLDERYKDVKDTLNTYKGAIETMVAALYEEETIEGNKVREIIKEFEDQNSLPTRLQELEEVKTEVKVEE

SEQ ID NO: 8549 - protein, 484 aa, Oryza sativa
  unsure (1)..(484): unsure at all Xaa locations
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLXLAEQLYEVAA

SEQ ID NO: 8550 - protein, 434 aa, Beta vulgaris
MDRYKLLKELGDGTCGTVYKAVNRESYEIVAVKKMKRKFYFWEECVNLREVKSLPSIESSHIIKLKEVVRENNDLFFIFEYMQYNLYQIMKDRHRPFTEEEIRNFLTQVLQGLAHMHRNGYFHRDLKPENLLVTNDVIKIADFGLAREVSSIPPYTEYVSTRWYRAPEVLLKSSLYTPAIDMWAVGAVLAELFTSCPIFPGESETDQLYKICCVLGAPDWAVFPEAKNISQLTSISYSQMLPANLSEIIPNANWEAIDLISQLCSWDPLKRPTAEQALHHPFFHVALRVPRPIHDPFHSKPDYTKTKPNLELNLWDFDSKADDCFLGLTLAVNPGVSSLEMGPRVSGSTRQDVYFCSSFQDHPEQSVFWSLFSPCRNGATPPVDPSLSLSFSSITHPRIAVPHSGGFGLAALQPGILDGPLLVVSSPHQPSHYL

SEQ ID NO: 8551 - protein, 251 aa, Xanthomonas campestris pv. campestris str. ATCC 33913
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGQTEAILRAQLEPVLSLVGSAGFARAVVAYEPIWAIGTGRTATPDQAQAVHAFIRGEVAKADARIADSLPILYGGSVKPDNASELFSQPDVDGGLVGGASLVAEDFLAIARAAAAC

SEQ ID NO: 8552 - protein, 444 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKVACKRGGKETKQIEEDGLVDVDGEKSKLAEDLSKIRMVESLDASASKQKLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 8553 - protein, 246 aa, Hordeum vulgare subsp. vulgare
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKTRVDNLQRTQRNLLGEDLDSLGIKELESLEKQLDSSLKHIRTTRTQHMVDQLTELQRREQMFSEANKCLRIKLEESNQVHGQQLWEHNNNVLSYERQPEVQPQMHGGNGFFHPLDAAGEPTLHIGYPPESLNSSCMTTFMPPWLP

SEQ ID NO: 8554 - protein, 294 aa, Glycine max
FGSRDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQADRSLGQKIASHLNLKPSI

SEQ ID NO: 8555 - protein, 305 aa, Enterococcus faecium
MNTVTVIGSINMDTTLRLTNMPKPGETMHAHEIFHAGGGKGANQAVAAKRSGARTSFIGGVGADSEGQQLLDLLTKENIDTSGIAEIQGATTGQAMIMVDAAGENSILIHAGANNAFHEQEVLKNKQLITNSDFIIAQFESSLDATILAFSIAKDAGKTTILNPAPARETIPTELLEKTDIIIPNETETEIITGIRVTDHNSLVAAAEKLHELGIGTVIITLGSAGAFYHTEKEHGIVPAFKVDAVDTTAAGDTFIGALSSTLQPDLSNLKEAILYGNLASSVAVQSYGAQPSIPYREALEQSAV

SEQ ID NO: 8556 - protein, 223 aa, Lepidium virginicum
MKNNKPSISFSFISLFLLVSAVAVSAINDEEPVKDTNGNPLKIETRYFIQPASDNNGGGLVPANVDLSHLCPLGIVRTSLPYQPGLPVTISTPSSSEGNDVLTNTNIAITFDAPIWLCPSSKTWTVDSSSEEKYIITGGDPKSGESFFRIEKYGNGKNTYKLVRYDNGEGKSVGSTKSLWGPALVLNDDDDSDENAFPIKFREVDTSKGSVFKKSSLRMFPFV

SEQ ID NO: 8557 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 8558 - protein, 528 aa, Oryza sativa (japonica cultivar-group)
MKQLAMELNNTEPLTASRAQAAAVFLLLPVALLLLLLRFARATTMAGDRNSELLLSKLPSPPLRLPVIGHMHLVGSLPHVSLRDLAAKHGRDGLMLVHLGSVPTLVVSSPRAAEAVLRTHDLAFASRPRAMVPDIITYGATDSCYGPYGDHFRKVRKAVTVHLLNSHKVQAYRPAREEEVRLVIAKLRGAAAMAGAPVDMTELLHSFANDLICRAVSGKFFREEGRNKLFRELIDTNASLLGGFNLEDYFPSLARTKLLSKVICVRAMRVRRRWDQLLDKLIDDHATRLVRRHDHDQQQDSDFIDILLYHQEEYGFTRDNIKAILVDMFEAGTDTSYLVLESAMVELMRKPHLLAKLKDEVRRVIPKGQEVVNEDNIVDMVYLKAVIKETLRLHPPAPLYIPHLSREDCSISGYMIPTGIRVFVNAWALGRDAKFWDMPDEFLPERFMDSNIDFKGHDFHYLPFGSGRRMCPGIHSATVTLEIMLANLMYCFNWKLPAGVKEEDIDMTEVFGLTVHRKEKLFLVPQAA

SEQ ID NO: 8559 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERFRILLRFADLIEKHNDELAALETWDNGKPYEQAAQIEVPMVARLMRYYAGWADKIHGLIVPADGPHHVQILHEPIGVAGQIIPWNFPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 8560 - protein, 224 aa, Listeria monocytogenes EGD-e
MRKIAASIMCADQLHLGDELQRLESAGVELLHCDVMDGVYVNNLALGPEYLEIVRNNTEIPLDIHLATITPLKYIDMFGPVKPEYISFHVEVAEDVSEIIRKIRSYNVKPSIAINPETPIEAIYPYLDDVEMVLMMTVNPGFAGQKFQTDVLQKLHDLKAKLAGKIHAPLIEVDGNINKETVGLMRDCLPDIYVLGTSALFHDRDKTSYAERLVHIWSNVEKHV

SEQ ID NO: 8561 - protein, 200 aa, Yersinia frederiksenii
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGK

SEQ ID NO: 8562 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKYWGYQLAREEFGGELIDGGPWLKVKKPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 8563 - protein, 104 aa, Zea mays
MAQSSGKVLVQWVVASLFIALLGGAQAIVLCNIDSSQLNLCRAAVTGKNPPPPDEKCCAVIRRANLPCLCRYKSILPSLGINAANALALPGKCGATTPPGCRAQ

SEQ ID NO: 8564 - protein, 443 aa, Pseudomonas putida KT2440
MTLRKIAGLGALLSLVMPGLALAEEAAPALNSGDTAWMLTATALVLFMTIPGLALFYGGMVRSKNVLSVMMQCFAITGLMSILWVVYGYSMAFDTAGMEKGVLNFNSFVGGFSKAFLSGVTPDSLTSATALFPEAVFITFQMTFAIITPALIVGAFAERMKFSAMLVFMGIWFTLVYAPIAHMVWSGDGALMWDWGVLDFAGGTVVHINAGIAGLVCCLVLGKRKGYPTTPMAPHNLGYTLMGAAMLWIGWFGFNAGSAAAANGTAGMAMLVTQIATAAAALGWMFAEWVGHGKPSALGIASGVVAGLVAITPAAGTVGPIGALIIGLVSGVLCYFCATTLKRKLGYDDSLDAFGVHGVGGIIGAILTGVFAAPALGGFGTVTDIGMQVWIQAKGVIFTVVYTAIVTYVILKVLDVVMGLRVNEEEESVGLDLAQHNERGYNL

SEQ ID NO: 8565 - protein, 759 aa, Schizosaccharomyces pombe
MSEKVDVGESVKGDASENAVKEVAERPIVMIDNYDSFTWNVVQYLSNLEKRYPIMVFRNDEITVDELEKLNPLKLVLSPGPGHPARDGGICNEAISRFAGKIPILGVCMGLQCIFETMGGKVDSAGEIIHGKVSKINHDGLGFYQGIPQNISVTRYHSLAGKISSLPDCLDVTSWTENGVIMGARHKKYAIEGVQYHPESILSEYGKEYIQNFLNLTAGTWEENGIVMPTKNNAFNAAMRENSNSVSSTKIRKQESILEKIHAQRLIDIAESKRKPGLSVGDLQTYLNLNIAPPCINFYERLKQSKPALMAEVKRASPSKGDIKLDANAAIQALTYAQVGASVISVLTEPKWFKGSLNDLFVARKAVEHVANRPAILRKDFIIDPYQIMEARLNGADSVLLIVAMLSREQLESLYKFSKSLGMEPLVEVNCAEEMKTAIELGAKVIGVNNRNLHSFEVDLSTTSKLAEMVPDDVILAALSGISSPADVAHYSSQGVSAVLVGESLMRASDPAAFARELLNLSSSEISNGKKTSTPLVKVCGTRSLLAAKTIVESGGDLIGLIFVEKSKRKVDLSVAKEISHFVHTTNRKHISPKKAVTGQSWFDHQYENLASSPHPLLVGVFQNQPLEYIRSIIAEVNLDIVQLHGQEPFEWIHMLDRPVIKVFPLNSSEISRPNYHIVPLIDAYVGGESGGLGKKVDWEAASFIPVSYVLAGGLTPKNVQDAISVSRPAVVDVSSGVETDGKQDLEKIKAFINAVKEL

SEQ ID NO: 8566 - protein, 100 aa, Zea mays
  unsure (1)..(100): unsure at all Xaa locations
MSGAGEEDKKPAEGGXAHINLKVKGQDGNEVFFRIKRSTQLKKLMNAYCDRQSVDMNAIAFLFDGRRLRGEQTPDELEMEDGDEIDAMLHQTGGSVPSTT

SEQ ID NO: 8567 - protein, 496 aa, Streptomyces coelicolor A3(2)
MLDQGAPPPHDASAVPPSPGLAARLMRRKPVERLVAEGGQGEGGSLRRSLGLWQLTMISIGATLGTGIFVVLGEAVPKAGPAVTLSFVIAGLTALFSALSYAELAGTIPVAGSSYSYAYATMGELVAWICGWCLVLEYGVSVAAVAVGWGEYLNELLDGTIGVTLPAALSAPPGDGGIFNLPALIVVLLAMTFLLGGARESACANTIMVVVKIAALVLFCAIGVQGFRSGNYEHFMPLGMAGVSAAGATLFFSYIGFDAASTAGEEAKNAQRDLPRAIMLSLVIVTVLYVLVAAVAVGAKPWRTFTDSEASLAQIMTDVTGQSFWGTLLAFCAVVAIASVVLTVLYGQTRVLFAMSRDGLVPKVFSKVHPKTGAPRANTLIVSLFCGVLAAAVPLGQLADATSIGTLFAFALVNVAVVVLRRTRPEMRRTFRVPLSPVLPALGFGLCVWMMGSLSTVTWVVFGVWMAVGLVFYFVYGHRRSRLATPVPSEARTHQK

SEQ ID NO: 8568 - protein, 680 aa, Glycine max
MAPTSYGFESQPKLETDNMPSTSGTAKSCSFKLGDRVKFSCSSSCGVYQTSPRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKERAAALAEGQPAPALCSSGDVRSLNMEDFKYAHQQVCASVSSESVNMTELLQWNELYGEGGSRVKKALSYFM

SEQ ID NO: 8569 - protein, 203 aa, Oryza sativa
  unsure (1)..(203): unsure at all Xaa locations
MAAEAAAALEGSEPVDLAKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIXNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 8570 - protein, 492 aa, Vigna radiata var. radiata
MDPYKYRPSSAFNSPFWTTNSGAPVWNNNNSLTVGTRGPILLEDYHLVEKLANFDRERIPERVVHARGASAKGFFEVTHDVSHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFSFLFDDLGVPQDYRHMDGFGVNTYTLINKAGKAVYVKFHWKTTSGVKCLLEEEAIKVGGANHSHATQDLHDSIAAGNYPEWKLFIQTIDPEHEDKFDFDPLDVTKTWPEDIIPLQPVGRLVLNKNIDNFFAENEQLAFCPAIIVPGVYYSDDKMLQTRIFSYADSQRHRLGPNYLLLPANAPKSAHHNNHHEGFMNFIHRDEEVNYFPSRYDPVRHAEKFPIPPAVFSGRREKIAIEKENNFKQAGERFRSWAPDRQDRFIRRWVDALSDPRVTHEIRSVWISYWSQADRSLGQKIASHLNMRPNI

SEQ ID NO: 8571 - protein, 884 aa, GIBBERELLA ZEAE PH-1
MLWAAPAMMEHSPKPPSRPRYAAMRDDQERDDQGERALDEQVERSPEEIEVLDRGQGIIAPSLLQGSTVDTPHGDDAKHRLAITYGLQNPQCDHASDPQQNQNQAPGVQIEKEGPGNSHRVGHLCQSIEHLRRGEFSRYLLRANVNQTMNNSPRGDSIRQGHLTLAKNGDLERDHLAGATLQGNDPYGQSPQNSYHNSPTRSPYGSSRGGRNGQQSHPQGSNYGPPSGPSSQYHPNPSRSPPHSAPTGPMQQYPQGGSYRGGYRGGGFRGGSFGNRGRGGFKNSHWNQGPPQRGHHDDLGNGRFSNVDEPSAMDIDRMDDGDESYQTHDRNAEDGADGLATPNRPPPTGPGSQSQSGGSGSKFSFAFKPSSKPALTAPKPEISQKLNAAPRRDAQKDSRDNDRDRSRDHDRERERDRDRDREREREREREREREKGRERDRDREPPRSAPTEPASSRSRHDRRQPPEGPRVTPRMRKVKKMMKRPKPRPTLPADLVDSESVFFRKPGNESVVGSGTYGKVFKGLNVYTKGMVALKKIRMEGERDGFPVTAVREIKLLQSLRHVNIVNLQEVMVEKNDCFMVFEYLSHDLTGLLNHPTFKLEAAQKKDLAKQMFEGLDYLHTRGVLHRDIKAANILVSNEGVLKIADFGLARFYAKRHQLDYTNRVITIWYRSPELLLGETKYTAAVDVWSAACVMVEIFDRNAIFPGDGTEFNQLEKVYNVMGTPNLKDWPGLVEMPWFELMRPTVKKKNIFEEKYREKMSPAAFELLSVMFHYDPVKRPSASEVLQHTYFTKEEPPARQATELSTHNDWHEFESKALRKENDRREREARKLAKEGASRDADKDKDKKRVNEGIDQPDAKRVQVDKNGGNKPTPAVTSSKPTEA

SEQ ID NO: 8572 - protein, 282 aa, Escherichia coli
ALLLKTQLPSGSELSLYDIAPVTPGVAVDLSHIPTAVKIKGFSGENATPALEGANVVLISAGVARKPGMDRSDLFNVNAGIVKNLVQQVPKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQSALEGMLDT

SEQ ID NO: 8573 - protein, 300 aa, Zea mays; identical to SEQ ID NO: 2533

SEQ ID NO: 8574 - protein, 358 aa, Raphanus sativus
QSDKPEQVQAPPPPPEQSNVHVYHHDWAAMQAYYGPRVAIPPQYYNSNGHAPAPPPPYIWGSPSPMMAPYGTPYPPFCPPGGVYAHPGLQMGSQPQGPVSQATPVVTTTPLNLEAPANSPGNTDQGFMKKLIEFDGLAMSISNNKAGSAEHSSGPRNSQSSENDDSSNGSDGNTTGGEQSRKKRSREGSPNDDGKPSSQIVPLLRDENEKPAVTMGTPVMPTAMDFPQPCHGAPHEVWNEKEVKREKRKQSNRESARRSRLRKQAETEELSLKVDALVAENMTLRSKLAQLNDESEKLRLENEASLAQLKATQTQAAGKTENLISRVDNNNNSVSGSSKNVEQQLLNVSLRTDSVAAS

SEQ ID NO: 8575 - protein, 712 aa, Bacillus sp. 38-2
MKRFMKLTAVWTLWLSLTLGLLSPVHAAPDTSVSNKQNFSTDVIYQIFTDRFSDGNPANNPTGAAFDGSCTNLRLYCGGDWQGIINKINDGYLTGMGITAIWISQPVENIYSVINYSGVHNTAYHGYWARDFKKTNPAYGTMQDFKNLIDTAHAHNIKVIIDFAPNHTSPASSDDPSFAENGRLYDNGNLLGGYTNDTQNLFHHYGGTDFSTIENGIYKNLYDLADLNHNNSSVDVYLKDAIKMWLDLGVDGIRVDAVKHMPFGWQKSFMSTINNYKPVFNFGEWFLGVNEISPEYHQFANESGMSLLDFPFAQKARQVFRDNTDNMYGLKAMLEGSEVDYAQVNDQVTFIDNHDMERFHTSNGDRRKLEQALAFTLTSRGVPAIYYGSEQYMSGGNDPDNRARIPSFSTTTTAYQVIQKLAPLRKSNPAIAYGSTQERWINNDVIIYERKFGNNVAVVAINRNMNTPASITGLVTSLPQGSYNDVLGGILNGNTLTVGAGGAASNFTLAPGGTAVWQYTTDATAPINGNVGPMMAKAGVTITIDGRASARQGTVYFGTTAVTGADIVAWEDTQIQVKILRVPGGIYDIRVANAAGAASNIYDNFEVLTGDQVTVRFVINNATTALGQNVFLTGNVSELGNWDPNNAIGPMYNQVVYQYPTWYYDVSVPAGQTIEFKFLKKQGSTVTWEGGANRTFTTPTSGTATVNVNWQP

SEQ ID NO: 8576 - protein, 316 aa, Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 8577 - protein, 870 aa, Cochliobolus heterostrophus
MASLLFLSLSGLAAGAAIQQRDPVPAGYVAPPYYPAPHGGWVSDWAESYRKASLLVSNMTLAEKTNLTAGTGIFMGRCVGNTGSALRVGIPQLCLQDGPLGVRNTDHNTAFPAGITAGATWDKDLIYRRAVAIGEEFRGKGVNIHLGPSVGPLGRKPRGGRNWEGFGSDPVLQAFGGSLSVEGIQSTGVIATIKHLIANEQEMYRMWNIVKPGYSSNVDDRTLHELYLWPFAEGVRSGVGSVMIAYNAVNGSACAQNSYMINGLLKDELGFQGFVMSDWLAQISGVSSTLAGLDMSMPGDRNDIPLVLGNSYWMYEQTRSVLNGSVPVDRVNDAVTRILATYFQMGQDQNYPRPNFDTNTQNAEGPLYPGALISPSGVVNEFVDVQGNHAEVAREVARDAITLLKNQDNILPLAASAPLKIFGTDAEKNPDGINSCADQGCNKGTLGMGWGSGSARYPYMDSPIDGFKARGANYQFFNTDNFPGNSNPSPNDTAIVFVTADSGENYITVEDNPGDRTSANLNLWHNGDRLIQDVAAKYSNVVVVVHTVGVILMNEWHDLPSVKAIVFAHLPGQEAGNSLMQVLYGDVSPSGHLPYTLPNAEDDFGNSVKLVGYQLGQPQDTFTEGLYIDYRHFHKANITPRYAFGHGLSYTTFSFSDATITPVTPLTRTPPARPAKGTTPSYSTAIPPASEAYWPANFNRIWRYLYSWLDKNDADAAAQVGTSPSTYPYPAGYSNEQKPGPAAGGAQGGNPALFDVAYDIAVTVTNTGNRTGKAVAQLYLQFPSESTVDTPILQLRDFAKTSTLAAGASQMLKMRLTRKDLSVWDVVEQNWVVPAVSGDYGVWIGGASDDLHLRCGTATGRCQGDQTSPV

SEQ ID NO: 8578 - protein, 396 aa, Sulfolobus acidocaldarius
MFGDVDSYKNRENNNNYDETLVKLLEEKIEALTKEIDKLRQDLNWYKTELEKLLAPPYIEATILDILPDGKVIVRSSSGPNLVVNVATNVDVSKLKPGMSVALSQRGSTIIDILPNREDIIVKSFELIEKPNIHYSDIGGLEDQINELREVVELPLKNKKLFEELGIEPPKGVLLYGPPGTGKTMLAKAVAAESNATFIHVVASEFAQKFVGEGARIVREVFELARKKAPSIIFIDELDAIAARRIDIGTSGEREIQRTLMQLLAEIDGFKALDNVKIIAATNRIDILDPAILRPGRFDRLIEVPLPDEKGRKEIFKIYLQRMRINENDKLNYDLIAQLTDGFSGADIKNVCTEAGYMAIREGRESIKFQDIIRAIDKIKKKNLRKAINTRTEKYL

SEQ ID NO: 8579 - protein, 446 aa, Zea mays; identical to SEQ ID NO: 8390

SEQ ID NO: 8580 - protein, 478 aa, Triticum aestivum
IPIRPSLSYAPPARLAPLLPRRRELLPRQPGTGGRRRLPLPPPPPPAPAPQRGVPLPSPLQCRTSENHRGAAMEGVKLASEAAANTNRRALRDIKNILGAPHQPHAVSKRGLQEKPAAAGAKSQPGAVGHRPVTRKFAAILQQTQPANAPLAPIGSERQKRNADTAFNAPSDMECSKASDDDLDEMMTNELKEIDMEDTEEEEMPDIDSCDVGNSLAVVEYVDEIYSFYRRTEELSCVSPTYMAHQSDINEKMRGILVDWLIEVHYKLELLGETLFLTVNIIDRYLARENVARKKLQLVGVTAMLLAAGFQVGGGPRAGRRGPVPHRPPPRQDILDMERKIVDRLEFNMSVPTPYCFMRRFLKAAGSDKKLELLSFFLIELSLVDYKMLKFQPSMLAAAAIFTAQCTLNGCMSWNKCCELHTKYSEEQLMDCSTMIVELHQGAARGKLTGVHRKYSTFKYGCAAKSEPAAFLLDARKA

SEQ ID NO: 8581 - protein, 384 aa, Staphylococcus aureus subsp. aureus Mu50
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 8582 - protein, 461 aa, Erwinia amylovora
  unsure (1)..(461): unsure at all Xaa locations
MKNVSSXVAVXRNPAXXXVXARXPXAXIDXVARALXLTHGAFQDWRXSVMSDRVRLLRNVAGALRQQARELAEMMTSEMGKPVDQGLAEVEKSARLCEWYAEHGPAFLQREPTLVEGNKAFVDYLPLGPVLSVMPWNFPVWQVLRGAVPILLAGNSYLLKPAPNVMGCALLLQQILSRAGVPQGLFAVVNADNDGVAQAINDRRIAAVTVTGSVRAGAAIAALSGAAIKKCVLELGGSDAFIVLAEADIDAAVKGAIAGRFMNNGQLCISAKRIIVEAAVFETFRDKFVCAVREMKIGDPRESGTWIGPMARYDLRDELDAQVQATLKEGATLLLGGHVLPGEGNYYAPTVLSDVKPGMTSFVQELFGPVASLIMADDAGHAVAMANDSEFGLGGSLWSRDLAVAQKLASRIETGSVFINSPSFSDPRVPIGGVKKXGFGRELSHFGLREFTNAQTVWMEG

SEQ ID NO: 8583 - protein, 316 aa, Pseudomonas putida KT2440
MHEHDVLCFGETMAMFVAEQAGDLAGVGQFGKRIAGADSNVAIGLARLGFKVRWLSRVGDDSLGRFVLDSLRCEGLDCSGVEVDANYPTGFQLKARSEDGSDPAVEYFRRGSAASRLSAAMVSPVWLQARHVHATGIPLALSDSCRALSHALLDGMRAAGRSISFDPNLRPSLWPDQSSMVREINALAAKADWVLPGLEEGRLLTGQHTPADIAAFYLDQGVELVVIKLGDAGAYFRSAKGEGQVAPVPVSRVVDTVGAGDAFAVGVLSALLEGRPVAEAVARGNWCGSRAVQSRGDMEGLPLRHELEAYDLRRSA

SEQ ID NO: 8584 - protein, 470 aa, Oryza sativa (japonica cultivar-group)
MASRRQWGAGAGAVDVPAQERKGGKAATDHLLRAFFAVFFVLEGLSWRRRRRRDGEGVFLLRYVACLLCLQAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 8585 - protein, 538 aa, Oryza sativa (indica cultivar-group)
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPQADYAWRIVLMFGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPATADHRTAPAPPA

SEQ ID NO: 8586 - protein, 397 aa, Nicotiana tabacum
MALQAAALVPSAFSISKEGKASANLKNSSLFGVSLSDYSKSDFGSSSFKVKSQRRLSNGAVRATMVASPDVTTNSPAGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFEISVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGFVSETEAGKRLAQVVSDPSLTKSGVYWSWNKDSASFENQLSEEASDVEKARKVWEVSEKLVGLA

SEQ ID NO: 8587 - protein, 464 aa, Glycine max
MANTLYNGATCRIPLRNQSLAFSRHVSRSLSFLPITRAAKQPNAIAVKASSHSDFDVDLSLSPRVNAVKPSKTVAISDHATALVQAGVPVIRLAAGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAGVAALGLGHAGGEAVSTMVKAFRERRDFLVKSFREIDGIKISEPQGAFYLFLDLSFYYGREAEGFGKIVDSESLCQYLLEVGQVALVPGSAFGDDTCIRISYAESLTTLQAAVERIKKALVPLSSAALV

SEQ ID NO: 8588 - protein, 149 aa, Oryza sativa
MAPIVIASLATSVAPFQGLKSTAGLPVSRRSTNSGFGDITNGGRIKCMQVWPVDGKKKFETLSSPGYYDGRYWTIWKLPMFGCSDNSQVIKELEEAKKAYPDAFIHIVGFDNVEPILMGPHIKGFMAYKPLGCEESDTTKPRSSITAQK

SEQ ID NO: 8589 - protein, 1230 aa, Cryptococcus neoformans var. neoformans
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 8590 - protein, 198 aa, Escherichia coli
MNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 8591 - protein, 502 aa, Pseudomonas aeruginosa
MEKTTTSPVGATYWRSRAENVEFEGRCLIDGKLIEAHSGQTFDCVSPVDGRVLTKVAEGGEADINKAVAAARAAFQDRRWAGQSPIFRKRTLQAFAALIRLHRDELALLETLDMGKPISASRSVDVEAVANCFDWYAEAIDKLYEQIAPTAENDLALITREPLGVVGAIVPWNFPMLTTAWKVAPALATGNSVVLKPAEQSPLTAIRLGQLALEAGIPEGVFNVVPGFGRSAGKALACHMDVDGIFFTGSTATGRLLTEYAAKTNLKRVCLELGGKSPNIILASYGDIEKAAVTAAESMFNNQGEVCIAPSRLIVERSIHKQVVEIVAEIARQRQPGDPLDPATRIGALVNAQHADRVMGFIERAKTDGATLAAGGTRALTETGGSYVVPTVFDNVSNDMEIAREEIFGPVLSVIPVSSVDEAVSVANDSPYGLGAGVWTDSLSDAHKISRKLRAGVVYVNCYNDCDITTPFGGVKQSGNGRDKSLYALDEYTELKTTWIRL

SEQ ID NO: 8592 - protein, 310 aa, Mycobacterium tuberculosis CDC1551
MPCSGWTCSRRGGTFSAMTSLQGKVVFITGAARGIGAEVARRLHNKGAKLVLTDLSKSELAVMGAELGGDDRLLTVVADVRDLPAMQAAAETAVERFGGIDVVVANAGIASYGSVLKVDPQAFRRVLDVNLLGNFHTVRATLPALIDRRGYVLIVSSLAAFAAPPGMAPYNMSKAGNEHFANALRLEVAHLGVSVGSAHMSWIDTALVRDTKADLPAFAELLARLPWPLNKTTSVNKCAAAFVNGIEGRKDRVYCPGWVALFRWLKPLLSTRVGQRPIRNTVAKLMPQMDAEVAALGRFASAYTESLENS

SEQ ID NO: 8593 - protein, 412 aa, Neurospora crassa
MADLLYDLLSPSFSGDPSSRPAPDSSSLEYLTSLSSQPLTALETTEPQALAQTSHGLLLSIQALSKKSHKQVIESATHHSTLRTSLPALAASTADLRHSIPKLDHEAVRFSTNYSKSSESDVLLRRKKALLLSRNVERLVDVLELPNLLSTAISTAPVNYSSALDLNGHIRRLHSLYPDSPLVTSIAAQADEAMRTMAANLIQSLKSPGLKLAASLRTISWLRRVLPDLEAAGTSKGHDSQERVLGALFLVCRLATLVNMLDALEPLRDLADQEKARQKAIGSGNAWSGGQQTERYLKRYIEIFREQSFAIQQDALEPMPAALATFPLHLVDMLLETLRLYLPTVKDQASRDSLLTQVLYCAGSLGRLGGDFGLFLASLDLGPEAEEEWVEVVKRHRALAGRLESIVGDQKK

SEQ ID NO: 8594 - protein, 472 aa, Pseudomonas putida KT2440
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 8595 - protein, 338 aa, Triticum aestivum
MRQLSSLLQGLARSMAGKERKEDDPQGTVLRSSGTLRGEGSETLAAVWSRRGEKGTNQDCSLVWEGFGCQDDTIFCGIFDGHGQWGHYVSKAVRDSLPPSLLRHWQEAVALASLIDGEKKLGDCQFDLWRQSYLAAAAAVDEELRRSRRLDAVNSGSTALSIVKKGDTMVIANVGDSRAVLGTTSDDGSIAAVQLTVDFKPNLPQEKARIVQCKGRVHCHEDEPGVHRVWLPDREAPGLAMSRAFGDYCVKDYGVISAPEVTQRRITSRDQFVILATDGVWDVVSNEEAVQIVADTPEREKAAKRLVQCAVRAWRRKRRGYAVDDCSAICLFLHPPPS

SEQ ID NO: 8596 - protein, 78 aa, Zea mays
HVDYACTPEEVQQHFQACGTVNRVTILTDKFGQPKGFAYVEFLEQEGVQEALNLNESELHGRQIKVAPKRTNVPGMKQ

SEQ ID NO: 8597 - protein, 333 aa, Zygosaccharomyces rouxii
MVNVSVNGFGRIGRLVTRIAISRKDINLVAINDPFISTDYAAYMFKYDSTHGRFDGEVSHDKDHIILNGKKVAVFNEKDPAALPWGKLGVDVAIDSTGIFKEMDSANKHIEAGAKKVVITAPSGSAPMYVMGVNEETYTPDQKIVSNASCTTNCLAPLAKVIHNEFGIKEGLMTTVHSMTATQKTVDGPSHKDWRGGRTASGNIIPSSTGAAKAVGKVLPSLQGKLTGMAFRVPTVDVSVVDLTVNLAKETSYDEIKAALKKASEGSMKGILGYTEDDVVSSDFLGDAHSSIVDAAAGIQLTPTFVKLVSWYDNEFGYSTRVVDLVEHVAKSA

SEQ ID NO: 8598 - protein, 472 aa, Hordeum vulgare subsp. vulgare
MTYGGERRGSNPTTVIHKTFLPLPLFRVLETTSSSCSSPSFPRPSFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 8599 - protein, 702 aa, Xanthomonas campestris pv. phaseoli
MAKSPSKSAQVPALAPVSATVDGARGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMVMWAMSDRTIPRSLRMIEGFGIHSFRFLNDKGESTFVKFHWRPKLGLQSTIWDEAVKIAGADQDFHRRDLFEAIQNGDFPEWELGVQLFTEAQAATFPFDHLDSTKVIPEELVPLQIVGRMVLDRWPDNFFAETEQVAYCPANIVPGIDFSNDPLLQGRLFSYLDTQLSRLGGPNFHQIPVNAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLSDGKQLAADGQLAGTPSVVFDAVAVLLSSEAAKLLTRESAALNFVSFAWAHLKAIAFDEGAQVLLKAGNVGKDAGVVPAADTKAFITAAKTRQWAREPKVRMLA

SEQ ID NO: 8600 - protein, 488 aa, Rhodobacter sphaeroides
MTRMTTTAGAPIADNQNTLTAGPRGPVLLEDYQLIEKLAHQNRERIPERVVHAKGWGAFGTFTVTNDITRYSCAKVFSEVGKQTDLAVRFSTVAGELGAADHERDVRGFSVKMYTEEGNWDLAGNNTPVFFVRDPMKFPDFIHTQKRHPRTNLRSATAMWDFWSLSPESLHQVTILMSDRGLPVDPMHMNGYGSHTYSLWNAQGERFWVKFHWKTLQGHAHYTNAEAAEIVGRTREGYQEALFGAIEEGRFPKWRLMVQVMPEAEAETTPYNPFDLTKVWPHSDYPLIEVGVMELNRNADNYFAQIEQLAFSPSNKVPGIGYSPDKMLQARVFSYADAHRYRLGTHYEALPVNAPRCPVHHYHKDGQMNFFGHRTGAVDAYYEPNSVPGAAVEDPAVAEPPLRISGDAARYNHREGNDDYSQPRALHDKVMTDEQRARLYANIAEAMAGIPEEIANRAIAQFDRVSPAYGEGIRAARARLAGALQAAE

SEQ ID NO: 8601 - protein, 383 aa, Oenococcus oeni MCW
MLYHSWKRTGIYTIVPVSLAGLPRVMFGAIFGGALAGQLADRLGRRKMILISAIIFAVFSVLSAIAPNNGSYYLIIMRIFLGLAVGAASALVPAYISELAPAAIRGRLSGLNQTMIVSGMLISYIVDYILKGLPNQIAWRLMLGFACIPAIILYLGVMKLPESPRYLIKNGRLDEARKVMSYVRSSEGEINNEINQIKETAHKEQEAQKTSWSALFSGKYRYLVIAGVGVAAFQQFQCANAIFYYIPLIVQKATGQAATSALMWPIIQGVILVIGSLVFMWIAEKFNRRTLLMFAGTIMGLSFILPAIIRWIDPHASQMMIVVFLCLYVAFYSATWAPLTWVLVGEIFPLAIRGRAAGLASSFNWIGSWAVGLLFPIMTASMS

SEQ ID NO: 8602 - protein, 217 aa, Aquifex aeolicus VF5
MKFFLDTANVEEIKKAMEWGILDGVTTNPTLISKTGRPFKEVVKEILELVDGPVSLETVSLDAEGMIREGRMLAELGENVVVKIPMTPEGLKAVIALESEGIPTNVTLVFSPTQALLAAKAGASYVSPFVGRLDDISGEGMKLIEEIKTIFSNYEFDTEIIVASVRHPMHVLESALIGADICTMPFKVMEQLFKHPLTDIGLERFLKDWEKVPEKPF

SEQ ID NO: 8603 - protein, 492 aa, Lycopersicon esculentum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPSCVLNGRRTNCVIPKENNFKQAGERYRSWEPDRQDRYINKWVESLSDPRVTHEIRSIWISYLSQADKSCGQKVASRLTVKPTM

SEQ ID NO: 8604 - protein, 445 aa, Hevea brasiliensis [sequence omitted]

SEQ ID NO: 8605 - protein, 343 aa, Agrobacterium tumefaciens str. C58
MMKMKAVVMTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVFLPHGA

SEQ ID NO: 8606 - protein, 488 aa, Utriculidium durvillei
MPEDVQNRTRIKSERYESGVIPYAKMGYWDADYNVKQTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYQRAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAATSCGPLKAALDLWKDITFDYTSTDTPDFVETATESR

SEQ ID NO: 8607 - protein, 473 aa, Hordeum vulgare
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVDEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDI

SEQ ID NO: 8608 - protein, 613 aa, Oryza sativa
MYAKQNRLQVDVPASKLVDSTQVTEQIILASLRRALTQHSSLQAHDGHWPGDFSGIMFIMPILERSIDALTKGRAWIISRGSAAAVPQWGKIWLSFIKLYDERVNASYSYILKVIGLYDWSGNNAIIPELWLVPHFLPIHPGRFWCFCRLVYMPMAYLYGKKFVGAITPTILEIREELYSVPYNEINWKNARNNCAKEDLRYPRSFVQNVIWTGLNKVVEPILSLWPFNTLRHAALNNLLKHIRYEDESTKYIGICPINKALDMICCWIDNPNSDAFKLHLPRIYDYLWLAEDGMKAQFHGCGHNGGDGLGIGAHSRWSWRGRQQAHGAGGAGSFKIKLEMVYDGCQSWETAFIVQAYCSTDLVNEFSQTLTKAHEFIKKSQVLENHPDYEAYYRHRSKGSWTLSTADNGWCVSDCTAEALKALLMLSKISQDLVGDPIDGERLYDAVDGMLSFMTYQLWGLIQILEADMNEDGTFSTYECKRSTPWLEVSTIKSYFLFKVKWFCTWGICFTYGTFFAVKGLAAARRTYENSSSIRKACNFILSKQLSETYLSSETKVYVEASRPHAVNTAWAMLALIYAGQVEIDPTPLYHAAQELINMQLETGEFPQQVSI

SEQ ID NO: 8609 - protein, 744 aa, Emericella nidulans
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAASAPLRHWHQTSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 8610 - protein, 88 aa, Oryza sativa
  unsure (1)..(88): unsure at all Xaa locations
MESGKHHACSSCDTKTTTTNAGAPVWNDNQALTAGPRGHRLLEDYQLIQKVMHLVRXAFGERVVHTSGAFAKGYXESTHNVTDNTCTG

SEQ ID NO: 8611 - protein, 304 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIGYPIANDRDSVHLVHKGNIMKFTEGAFKDWGYQLAPEEFGGELIDGGPWLKVKNPNTGKKIVIKNVIADAFLQQILVRPAELNVIACLNLNGDFISDPLATQVG

SEQ ID NO: 8612 - protein, 239 aa, Francisella tularensis
MSDINIKIGLAEMLKGGVIMDVVNAEQAEIAQQAGAVAVMALERVPADIRKDGGIARMSDPKLIKEIMSVVSIPVMAKARIGHFVEAQILESLGVDFIDESEVLTPADELNHIDKDSFKVPFVCGCTNLGEALRRIGEGAALIRTKGEAGTGNIVEAVRQLRQVNKDINYIKNADKSELMAIAKNLQAPYDLVTYVHKNGKLPVPNFSAGGVATPADAALMMQLGAESVFVGSGIFKSA

SEQ ID NO: 8613 - protein, 145 aa, Zea mays
MISSKKLAQLSKKMQGMGAVGRRRVTVVRKEINPSCSSIVAGKGNCIVYSSDGKRFEIPLSYLHTAVFVELLKLSQEEFGFTSDGRITLPCDKAVMEYVMCLLRREASEDVEKALLSSIVMSCHHTNRMVQPPSGVNHHFAVCSS

SEQ ID NO: 8614 - protein, 439 aa, Pyrobaculum aerophilum str. IM2
MAVDIEKIKQGIPNIVPYAGKYVDPPEGDYVEYTGPGQFKVPDKVVIGYIEGDGIGPEVAYAAIRVANAAVEKAYGKSRKVIWYEVVVGEKAEKIFGNRLPDQSINVLKKIRVFLKAPLETPVGGGFRSINVTLRQLFDLYANIRPVKYFPGLPSPLKRPEVVDLVIFRENTEDVYAGIEWPYNSPEASKIRDFLRREFGINIRDDAGIGIKPISKFGTQRIARLALKFAIENKRRVVTVMHKGNIQKYTEGAFKDWAFEVARNEFREHVVFEDELAQYGGQVPPGKVLVNDRIADNMLQQLLTRTGEYDVILAPNLNGDYVSDEAAGLVGGLGVAPGIDVGDWGMMAEPVHGTAPKYRGKNYVNPTATILALELLFRFLGWREAANYIIKGVETAYREGYFTGDLARQMDEEERKHRVKEVLGTQEFADKVVEIIKRL

SEQ ID NO: 8615 - protein, 387 aa, Geobacillus stearothermophilus
MKKKCIAMLLAGGQGSRLRSLTTNIAKPAVPFGGKYRIIDFTLSNCTNSGIDTVGVLTQYQPLLLHSYIGIGSAWDLDRRNGGVTVLPPYSVSSGVKWYEGTANAVYQNINYIEQYNPDYVLVLSGDHIYKMDYQHMLDYHIAKQADVTISVIEVPWEEASRFGIMNTNEEMEIVEFAEKPAEPKSNLASMGIYIFNWPLLKQYLQIDNANPHSSHDFGKDVIPMLLREKKRPFAYPFEGYWKDVGTVKSLWEANMDLLDENNELDLFDRSWRIYSVNPNQPPQYISPEAEVSDSLVNEGCVVEGTVERSVLFQGVRIGKGAVVKESVIMPGAAVSEGAYVERAIVTPDSIIPPHSSVCPEDADDVVLVTAEWLKQSNEETARKDEA

SEQ ID NO: 8616 - protein, 461 aa, Gelidiella acerosa
YWDPDYQVKETDVLALFRVSPQPGVDPVEASAAVAGESSTATWTVVWTDLLTACDLYRAKAYKVVEVPNATDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADYVETPTANV

SEQ ID NO: 8617 - protein, 351 aa, Staphylococcus epidermidis ATCC 12228
MKKQLDQLTAYTPGLSPESLKKQYGIRGELHKLASNENVYGPSPKVKTAIQSHLDELYYYPESGSPKLREAISQQLNVDASRILFGAGLDEVILMISRAVLSPGDKIITSESTFGQYYHNAIVESADVIQVPLKDGGFDLDGMLQQIDNKTSLIWLCNPNNPTGTYFSHDELFNFLKRVPSDIPVLIDEAYVEFVTADDFPDTLKLQEDFDNAFLLRTFSKAYGLAGLRVGYVIASEDAIEKWNIIRPPFNVTRISEYAAIAALEDQEYLKEVTQKNSFERDKFYQIPQSQHFLPSQANFVFVKTSRSQALYDALLNVGCITRLFPNGVRITIGLPEQNNKMIEVLKHFEY

SEQ ID NO: 8618 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFEYIFLPETKGIPIEEMGQVWRSHWYWSRFVEDGEYGNALEMGKNSNQAGTKHV

SEQ ID NO: 8619 - protein, 305 aa, Zea mays
  unsure (1)..(305): unsure at all Xaa locations
MASDGSGVVTVYGNNGAALLEPPKQPKSSTFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLXATPADAALMMQLGCDGVFVGSGIFKSGDPARRARAIVQAVTHYSDPTILADVSTGLGEAMVGINLNDPKVERYAARSE

SEQ ID NO: 8620 - protein, 524 aa, Bifidobacterium longum DJO10A
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 8621 - protein, 243 aa, SYNECHOCOCCUS SP. WH 8102
MRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQAI

SEQ ID NO: 8622 - protein, 2387 aa, ASPERGILLUS NIDULANS FGSC A4
MRWRPLNPLLPLLAATAAGWPYEESLVDYNLNVNKNAATPADYYAPEWRNHTYMPSPENWRFPFYTLFLDRFVNGDPTNDNINGTVYEHDLNSNQMRHGGDAQGLVDTLDYLQGMGIKGIYLAGTILMNQPWGADGYSILDTTLLDQHFGTIQTWRNAITEIHKRGMYVLFDNTIATMGDLIGFKGYLNVSAPFSVKEHEAVWKSDRRYVDFDFGNTYNQTCEYPRFWNETGWPVDKDVRDELQGCYSSDFDQYGDREAFGVYPDWQRQLAKFASVQDRLREWNPSVRERLIRHSCMIIKALDIDGFRYDKATQATVDALGDMSSAYREITGGNNFGSIYLGRGRQPNQYPDSAMDSMAMNNESDHQYFLREDGLQALDSAAFHYSIYRSLTRFLGLDGNLAAGYDTPIDWTDAWNVMVMTNDMINANTGKFDPRHMFGATNQDVFRWPAIKQGIERQLLAMFITTLHLPGIPILLWGEEQGFYILDATADNYVYGRQAMSPATAWKTHGCFQLTADQYHNWPISKGREGCHDETVTYDHRDPSHPLRNIIKHMYQLRQDYQVLNDGYSVQKLSNQTRQIFYPGSNGTATETGMWSVLRDSVYKIQELHNEQPVWLVYQNDNKTVEYNFDCSDNDTALISPFATKTTVVNLFYPHDEYDLKDGPKKLHLNGSAEFNGCLDSMTLKPFEFKAFVPKERFVKPRPMITKITPGHDQPIISKVVASEAEDLDLSIYFSAEMDCDSVTKAIKVQSTTEVNKTALIDKDSVKCRRIDPNETRWTAQLPSVWAWSSKLTGVYNGIHRLTVTNATSEVGGSTQAVDHFLIRIGQIDNPMVFTTANYSTDLLHQHENGTLYIRHKAAGADKYRYSTNWGSSFSNWREYKGGDEFIEEQPWSGTKKQKWNGKHVRVEYWSKLTGSSSYVQEGDYDTKHQRRFPHLFFNGPYNQYGYDAGLDNEVKQDSDGYWKYRLRAEFPAQGQFNVWGMNPDGKPDQSFVFGDLDSDGVLDRMPPSSLNTLSINVTDRPPSSYLSWNIWVDDGTMSIQFQPTGSRTIQMVVYFLLWFVPLVTAIGCVYAFMKSFYQVKFNQIGISQKRSLFGFSVGRKPSLNPLTRLANKSGFLQSTPVFGTGSSRRRSVLIATMEYDIEDWGIRIKIGGLGVMAQLMGKNLGHQDLIWVVPCAGDVDYPEDQPAEPMFVTVLGNIYEVKVQYHVLNNITYVLLDAPVFRQQSKAEPYPARMDDLDSAIYYSAWNQCIAETIKRFPIDLYHINDYHGSIAPLYLLPQTIPVCLSLHNAEFQGLWPMRTQKERDEVCSVFNIDVDVARRYVQFGEVFNMLHAGASYLRVHQQGFGAVGVSRKYGKRSYARYPIFWGLKKVGNLPNPDPSDTAEWNKELPKESEIQVDQNYEASRAELKRQAQEWAGLEQNPNADLMVFVGRWSMQKGIDLIADVMPAVLEAHPNVQLICVGPVIDLYGKFAALKLDRMMQLYPGRVFSKPEFTALPPYIFSGAEFALIPSRDEPFGLVAVEFGRKGALGIGARVGGLGQMPGWWYNVESTTTAHLLHQFKLAIGCALNSKPQVRARMRARSAKQRFPVAQWVEDLEILQSTAMRIHSKGLAKASVQPYNSGSNTPLGMMTPPIASTGTVTPTGIQTPPLAHSRSGSYSNINRLSAYGPQQRNTIIYSRDPSPGGEDQPRSGIRQLSLGVRAGPGHLMRRGRRRLRRNSHAGTDENASVSMTEESSDDDIIPSFYGEEEYTLTPEQAEEVRRADMTPQQEQNHGSVRDFFTRRHSSQSSILSRSVLSPASSTTFDGDETFVPPAPPFAEPGNRLSSASVLSVDSVVGEKKDYKLQKVDPTFTDSTGEFYKVFERKLEKLNGSNSISQLCIEEYLEKSEKKWFDRFRDARLGRKQSPSSSIFRTKFEGSSPMALVSNDEVGSRASGSEPRMRPDEFCLGNDYVPPSGLKKWMQVRIFDWPIYSFILGLGQIIAANSYQITLLTGEVGQRPEKLYGIATVYLVSSIVWWFLFRFCKSVVVLSLPWLFYGFAFVLIGVAHYEGDSFARAWIQNVGAGVYAAASASGSLFFALNFGDENGAPVKNWVWRACIIQGTQQAYIIGLWYWGTSISQAVTRGVPDVQAHITETWRMTTICMPIAVFLWVLGILVFFGLPNYYRQTPGKVPSFYQSVCRRKIILWNFVVVILQNFFLSAPYGRNWSFLWSSVHAEPWHIGLLVVAFFGVAWVLILCIFARLSKSHSWILPVFACGLGAPRWAQIWWGVSGMGLFLPWAGSYTTGALVSRSLWLWLGILDSLQGLGFGMILLQTLTRMHICFTLLASQVLGSIATICARAFAPNNIGPGPISPDITDGAGAVANAWFWIALFFQLLICSFPIDVMS

SEQ ID NO: 8623 - protein, 175 aa, Glycine max
  unsure (1)..(175): unsure at all Xaa locations
MSARLMKKVLNEQHHLPQHVSGEEEEEEEENDSEPITRSSINPFDLLNDNDSEPEDQGDELMSTNERLASYDDEEESSSLKPTAEVSTSNPKSKKKKKKKNKDSAVVNKTGEDKELDLILENLSLNVNSSAEQPVSTKDKNKSVKQQAASILQVDXKCLNAENELRRIFGSKVVK

SEQ ID NO: 8624 - protein, 793 aa, Gaeumannomyces graminis
MLRSSAFALLAWASLSEAQFGIKHTQYGTSEPVYPSPEISGSGGWEAGLAKAKDFVAQLTPEEKANMVTGTPGPCVGNIAPVPRLNFTGLCLQDGPATLRQATYVTVFPGGVSAASSWDKDLIYKHGVLMAEEFRDKGSHVILGPVIGPRGRSPYAGRNWEGFSPTSYLAGVMAEQTVKGMQSVGVQACTKHFIGNEQEEQRNPTAVDGKTVEAISSNIDDRTMHEAYLWPFYNAVRAGTTSIMCSYQRINGSYGCQNSKTLNGLLKTELGFQGFVVSDWAATHSGVASIEAGLDMNMPGPLNFFAPTFESYFGKNITTAVNNGTLSSRRVDEMIERIMTPYFALGQDKNYPPVDGSTVSVGFSQPGFWSHEFPLGPTVDVRRNHHEHVRELGAAGSVLLKNEKGALPLKKPMNIGVFGNDAADVTRGPYMAGGPFGGVGGDCDIGTLPLGGGSGTGRYTYVFPPLEDIKARGRSYGALVQYITSNEVITSGGLVTIFPVPEVCLVFLKSWATEGEDRISLEAQWNAAVVVEKTAVLCNNTIVVIHGGAPVVMPWRNNPNVTAILAAHMPGQENGHSLVDLVWGDVNPSGKLPYTLADQATDYNKNLVNSTELVQSTDPDAWQADFLEGQLIDYKDFDAHNKTPAYEFGFGLSYTTFELSGVQVEVQASNPSRLPDPSAPIAPGGNVQLWETLATVKATVKNTGDREGATVAQLYLSLPGAEAGKDTPVRNLRGFEKVKLAPGACAEVEFALMRRDLSFWDTTAQAWRLPEGAIGVDVGFSSRDLKLKSEIKI

SEQ ID NO: 8625 - protein, 243 aa, Cucumis sativus
DDVGIPINYRHMEGFGVQAYSLINKSGKARLVKFHWKPTCGVKSMLEEEAIRIGGTNHSHATQDLYESIAAGNFPEWRLYIQTIDYDDQNNFDFEPLDTTIEWPEDVIPLQPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDPCRHAEKFPMPPNVLSGKRERCVIPKENHNFKHAGS

SEQ ID NO: 8626 - protein, 312 aa, Oryza sativa (japonica cultivar-group)
MGEEKVAPKSDAAPAVELLGFVMSAEEAERAAAAAGVETVEDLLPLLVPSAMRRARAPISRFPVGAVGLGASGRVYAGVNLEFRGLPLSHSVHAEQFLVVNAAAAGESELRAVAVSHMPCGHCRQFLQEIRGAGGIRIIVTSDAEDGCAPEWRTVASLLPRPFGPHDLLPKHVPLVLEPHDNPLGEPAAVANGFAHGDLEARLREAAEAAARAAHAPYSECPSGFAVADGEGKVYAGGCLESAAYNPTLGPVQAAIIGMVAAGGGAAGDVVAAALVEKEAGLVSQEATARIFLAAVAPQATFHVYNYTPSDA

SEQ ID NO: 8627 - protein, 498 aa, Mesembryanthemum crystallinum
MTLDSIPGSSGYLDSYPERRITYFGNKFVLALTVTAGIGGLLFGYDTGVISGALLYIKDEFPAVKNSSFLQETIVSMALVGAMIGSATAGWINDVYGRKKATLLADFIFAIGAVVMAAAPDPYILIVGRFLVGLGVGLASVCAPVYIAEASPTEVRGGLVSTNVLMITFGQFVSYCVNLAFTEVPGTWRWMLGVSGVPAVLQFGFMLLLPESPRWLYLKHEKSKAAAVLAKIYDPFRLEDELDLLAAAEEEEKNKPAVHISDVFTKRELRYAFIAGGGLLAFQQLAGINTVMYYSPTIVQMAGFSSNQLALLISLIVAAMNAVGTVLGIYLIDHMGRRKLALTSLSGVFVALVMLTISFMLRSSGPTSALYSWLAVLGLALYIAFFAPGMGPVPWAINSEIYPQAYRGLCGGMGATICWIVNLFVSETFLSIADAIGTGPTFLIIAGIVIVAFVFVVCFVPETKALTFEEVDQMFMDRAYGTEENTQSLLESSNRSGN

SEQ ID NO: 8628 - protein, 292 aa, Zea mays
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTLFFLFDDVGVPSDYRHMEGFGVNTYTFVSAAEKATIRKPNDFKQPGERYRSWDADRQDRFVRRFADSLGHPKVSQELRSIWIDLLAKCDASLGMKIATRLNMKPNM

SEQ ID NO: 8629 - protein, 435 aa, Zea mays
MPIQKILARTIFDSRGNPTVEVDLTTDKGLFRAAVPSGASTGIYEALELRDGDKANYHGKSVFKAVSNVNDVIAPALLAQNFNLTQQRDIDNFMLNLDGTENKSKLGANAILGVSLAVCKAGAAEAGLPLYAYIAKLAGNDKIILPVPAFNVINGGEHAGNKLPMQEFMILPTGAATFREAMKIGSEVYHHLKAVIKKRFGLDATAVGDEGGFAPNILDAKDALELIKTAVEVSGHASKIEIGMDVAASEMYKRDQKKYDLDFKNPQSDPTKWITSAELGALYQKFATEYPIVSIEDPFDQDDWEAWTALTGAVNFQIVGDDLTVTNPKRIQSAVEKKACNCLLLKVNQIGSVSESIDAHLLAKKNGWGTMVSHRSGETEDTTIADLVVGLSAGQIKTGAPCRSERLAKYNQILRIEEELGDKAIYAGKNFRHPA

SEQ ID NO: 8630 - protein, 320 aa, Bacillus subtilis subsp. subtilis str. 168; identical to SEQ ID NO: 302

SEQ ID NO: 8631 - protein, 367 aa, Shigella flexneri 2a str. 301
MRQVRFPRTICWITLSGKFAQGKPCRRSMTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 8632 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 8633 - protein, 580 aa, Streptomyces coelicolor A3(2)
MAKQNVAEQFVDILTRAGVERLYGVVGDSLNPVVDAVRRHSGIEWVHVRHEETAAFAAGAEAQITGKLTACAGSCGPGNLHLINGLYDAHRSMAPVLALASQIPSSEIGLGFFQETHPDQLFRECSHYSELISSPKQMPRLLQTAIQHAVGQGGVSVVSLPGDIADEPAPQGAAETALVTSRPTVRPGDEEIDRLVRMIDDADKVTLFCGSGTAGAHAEVMEFAGKLKAPVGHALRGKEFIQYDNPYDVGMSGLLGYGAAYEATHECDLLLLIGTDFPYNAFLPDDVKIAQIDVRPEHLGRRSKLDLAVWGDARETLRCLIPRVKEKKNRRFLDRMLKKHADALEGVVKAYTRKVDKHVPIHPEYVAALLDEMADDDAVFTVDTGMCNVWAARYISPNGRRRIIGSFSHGSMANALPMAIGAQFTDRRRQVVSMSGDGGFTMLMGDFLTLVQHDLPVKIVLFNNSSLGMVELEMLVAGLPSHGVANKNPDFAAVAEACGAFGVRVEKPKDLAGALKAAFKHKGPALVDVVTDPNALSIPPKISADMVTGFALSASKIVLDGGVGRMLQMARSNLRNVPRP

SEQ ID NO: 8634 - protein, 518 aa, Zea mays
MGTVGGGELPVADPAAADADRARLQQLGYKQELKRGLSVVSNFAFSFAIISVLTGVTTTYNTGLRYGGPASMTLGWLVVATFNGCVALSMAEICSAYPTSGGLYYWSAKLAGNEWAPLASWVTGWFNIVGQWACTTSVDFSLAQLIQVIILLSTGGANGGGYLASKYVVLAIYTAILVVHGLINSLHIQWPSWFGQLGALWNVAGVFVLVILVPSVAKERASAEFVFTHLNTDNGMGIHSKAYILAVGLLMSQYSSIGYDTSAHMTEETKKADWSGPMGIVYSVALSSVFGWVYLLALTSVVTDIPYLLDTGNDAGGYAIAQALYDTFRRRYGTGAGGIACLVIIAVAVFLCGTACVTSNSRMGYAFSWDGAMPFSHLWYRVNKQEVPFNVVWLSVSVAFVMALTSLGSQVAFQAMVSIATLGLYIAYALPIFFRVTTARKSFVPGPFHLGRCGIAVGSVAVLWVALVTVLFCLPVAYPVAKDTFNYTPVAVGGVLVLSLVAWVLHARFWFRGPITNV

SEQ ID NO: 8635 - protein, 364 aa, Aquifex aeolicus VF5
MKKYKIAVLKGDGIGPEIVEQALRVLDKIGEIYGVEFEYREGLIGGEAIDKTGDPLPEETLKICKESDAILLGAVGGPKWDNLPTDKRPEKGLLRIRKELDLYANLRPAKVWDALISSSPLKEEVVKGTDMIVIRELTSGIYYGEPRGIFEENGKRYAINTMKYTEDEIRRIVRKGFEIARKRRKKLTSVDKANVLEVSALWRQIVEEEKENYPDVELEHLYIDNCAMQLVRRPTSFDVIVTGNIFGDILSDEAGVVVGSLGMLPSASIGDRYALYEPVHGSAPDIAGKGIANPIATILSAAMMLKYSFNMDKAHDLIEKAIEETLNQGYRTPDIYSEGCIKVGTKEITDKILENLERLKDAYT

SEQ ID NO: 8636 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 8637 - protein, 468 aa, Cryptopleura callophylloides
  unsure (1)..(468): unsure at all Xaa locations
IPYAKMGYWDPDYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQTMAIWARKNDMILHLHRAGNSTYSRQKIHGMNFRVICKWMRMAGVDHIHAGTVVGKLEGDPLMIKGFYDTLLLPYLDVNLPLGIFFKQDWASLRKVTPVASGGIHCGQMHQLLDYLGNDVVLQFGGGTIGHPDGIQAGATANRVALEAMVIARNEGVDXXXXXXXXXRDAAKTCGPLQTALDLWKDITFNYTSTDTADFVETPTANV

SEQ ID NO: 8638 - protein, 549 aa, Streptomyces avermitilis MA-4680
MAENVTSLFRSTSAHSPSMAALTRESDGAGPVDFCIPCNPYFPTPAMFDDLAGRLREIITYYPSSADTITAELCNLLQLPPQCVAMGNGSTELITWIDHLLVRESLAIPVPTFGRWTDQPMETGKRVDMFPLQESSGFALDLAQYAEFIRARGTRVAVICNPNNPDGGFIPRQSLIQFMDAMADLDLIVIDESFLEFADAENEPSVVEDAVMRPNVIVLRSLGKNFGLHGIRFGYLVANPALAGKVRSMLPKWNLNSFAETVVFMLKEHGAEYLESLHMVRRDRLDMARQLSALPGLTVYPSQGNFLFVRLPVGAEGTVVRDRLLTEHRILVRECGNKIGSSSRFLRLVVRPQVDVRRLVSGLEQVLYGTRRGAAVPELGTGTSYSSGTAAVDRLVGETNGAGMPGLAAQAAGMQSLAPGAAQAQNPYPPQSPYPTPAPAAMPAPAPMPAPAMPAPAPMPYAAPAAAMPSMAPAPNAPMPGMAPAPAAGLTAVAQTGMPGLASAAQNNRRGMGAAQGLTAAQVRGRTQPEPTPEPTGWPAAGAMYNQVG

SEQ ID NO: 8639 - protein, 492 aa, Nicotiana tabacum
MDLSKFRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHERGSPESLRDIRGFAVKFYTREGNFDLVGNNVPVFFNRDAKSFPDTIRALKPNPKSHIQEYWKILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWISYLSQADKSCGQKVASRLTLKPTM

SEQ ID NO: 8640 - protein, 336 aa, Ralstonia eutropha
MTIKVAINGYGRIGRNVLRAHYEGGKRHDLEIVAINDLGNAATNAHLTQYDTVHGRFPGEVSVDGDAFRVNGDRIRVLAQRNPAELPWGELGVDVVMECTGLFTSKEKASAHLKGGAKKVIISAPGGKDVDATIVYGVNHGVLKATDTVISNASCTTNCLAPLVKPLHEKLGVVNGLMTTVHSYTNDQVLTDVYHEDLRRARSATMSMIPTKTGAAAAVGLVMPELDGRLDGFAVRVPTINVSLVDLSFVAARPTTVEEVNGILKAAAEGELKGILDYNTAPLVSVDFNHNPASSTFDATLTKVNGTLVKVSAWYDNEWGFSNRMLDTAVALAHAR

SEQ ID NO: 8641 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 8642 - protein, 465 aa, Enterococcus faecium
MGLGTFIGLTMALCATVRSIPTLAAVGWTLIFYSIFAVLFFAGPISMVSGELSTMLPQEGGPQLWVKTALGSKWGFVVAWLLWVQMFPGMVMVASTLGPLLGNTFGNVELGNNHWFVLGCILVIYWIITILNLKFDMAKVGGNIGVWLGVYIPVVIMFVLGVLAAFKVGLVSNGYLGDFSWSKAFPDLEHIDSLKYLAGITFIFVGIEMSSVYMPRLKDATKNYTKGVFIALIGLVLLNVINAMLVANVVPDGKMELANITQPILIDCQILGLPEVIGNIFSFMVFIGVLLQLSAWVTGPSKTIIQVAREGFLPPKFGFHKENKYGVSRNVVLTQSIVISLFALLYGVMDDVSAVFLTLTNATTVIYCIVYILIAVSLLKMRKKHPEFERPYRIGKNGNGLAWVVSCMLIFSIIVVVFATLGTATLSDALLVAAITVVMFVIPLIINHFKKDSWGIEVEKSLEEK

SEQ ID NO: 8643 - protein, 516 aa, Oryza sativa (japonica cultivar-group)
MDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNVSYRTAITLAIDQDLHLTATAR

SEQ ID NO: 8644 - protein, 178 aa, Helicobacter pylori
MLTIKDIHALEVMDSRGNPTIQASVILSDNTKASAIVPSGASTGKREALELRDNDKTRFLGKGVLRACENVNSVIKHHLIGLEATNQAFVDERLRALDGTPNYANLGANAVLGVSMALARASAKALNLPLYRYLGGANALTLPVPMLNIINGGTHANNSIDFQEYMIMPLGFESFKEA

SEQ ID NO: 8645 - protein, 404 aa, Zea mays
  unsure (1)..(404): unsure at all Xaa locations
FFFLLSVRQDGNCIVLNWEIATALAVVRSVTDAIYFLHMLLQFRLAYVAPESRVVGAGDLVDEAGGXAIHYFRGYFLLDFFDVLPLPQVMILLVVPKVGLSAANYAKNLLRVTVLLQYVPRIIRFVPLLDGQSTNGFIFESAWANFVINLLMFILAGHVVGSCWYLFGLQRVNQCLRDACSISTIPYCDSFIDCGRGIGSGLCRQEWVNDSGAEACCXTPGNDAAFQYGIYEQAVLLTTEDSAVKRYIYSLFWGGQQISTLAGNLVPSYFIGEVLCTMAIIGLGLWLFALLIXGNMRKIFCKRLGKKNIRRALSMHTYIDAVDRGIEIIKCVSWALIQRGGHLIYXDRGSIMRWEMQLRRRDVEKWMSHRRLPEDLRRRGRRAQRCTWAATQGVNEEELLSNLP

SEQ ID NO: 8646 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISYALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 8647 - protein, 318 aa, Arabidopsis lyrata
  unsure (1)..(318): unsure at all Xaa locations
MDSDFVPPISLKLPVIDFSNQTLKPGSSKWDEVKADVRKALEDYGCFEASFDKVSVELKTSVFEAMEELFELPIQTKQRNVSSKPFHGYICHNLYQSXGIDDANVLVKVNDFTQQLWPDHGNKSISETIHRFSDQLLELDVMVRRMIMESFGIEKYIDEHLKSTNYLFRMMKYTTPLDADVEETQVGLRAHTDKNIITILHQYQINGLEVKTKNENWIKVKPSQDSFVVMVGDSLCALLNGRLPSSYHRVMMMGNKTRYSTALFSAPKLETIIDSPEELVDEEHPRMFKPFDYNDFVHFFHTEAGRKAQSTLHAFAAF

SEQ ID NO: 8648 - protein, 367 aa, Paracoccus denitrificans
MSQNQTTIRPQPGIMEISLYEGGASKVAGVENVVKLSSNENPFGPSDKAREAMIRAAHGLHRYPNTDHAGLRGAIGEVHGLDPDRIICGVGSDEIIHFLCQAYAGPGTEVLFTEHGFLMYRISAHAAGAIPVQVAERDRVTDIDALIAGATPTRLIFVANPKNPTGTMVGLPELERLARAVPQRIALVVDAAYAEYVGDYDGGAQLAQALPNVFMTRTFSKIYGLGGLRVGWGYGPREIVDVLNRIRAPFNLSNVALEGAEAAMRDREHIARCQAENARMRAWLAEALAEKGVPSDTSCANFILARFADAETAGACDEYLKTQGLIVRRVAGYGLPHCLRITIGDEASCRRVAHVIASTWPSAAESR

SEQ ID NO: 8649 - protein, 499 aa, Burkholderia fungorum
MRKLLMSLLMAGSLLAGGIGAALADDASAPAAASAPDATASAPAPDASAAPAAAAASAPAADASAAPAASAAAAPAASDAAPAAPTAPFSVDSSKINSGDTAWMLTSTALVLFMTIPGLALFYGGMVRKKNVLAILMQSFAITCVVTIVWIVIGYSLAFTPGSSFIGGFSRVFMAGMSYIKGDKATTLTVSHLAPTIPETVYCVYQMTFAIITPALITGAFADRMKFSAMLVFMTLWSIIVYSPIAHMVWEPTGWLASAGILDFAGGTVVHINAGIAALVCALVLGKRIGYGKEAMAPHNLTLTLIGGAMLWVGWFGFNAGSAVAADGRAGFAMFATQVATAAAALAWMFAEWAAKGKPSVLGIVSGAVAGLVAITPASGFVGTLGSLVIGIVAGVVCFWSATWLKHKLGYDDSLDAFGVHCIGGIVGALLTGVFAVKDIGGADGSVILQAKGVLTTLIYSGVVSYILLKIIDMVMGIRVTEEQEREGLDVSLHGEHVE

SEQ ID NO: 8650 - protein, 357 aa, Dechloromonas sp. RCB
MQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 8651 - protein, 363 aa, Oryza sativa (japonica cultivar-group)
MALEAVVFSEGYYFGCGGAMAAEAAAGGAWSWSHGYGGGVDQGKGAMELVVDDGVVNAFWDGGGGGASSSPVMAAVSGFIEEPDGGNSSVADAAPPPEHGGASVVGRDGSAAAPAAAAGRRKRRRARTVKNREEVESQRMTHIAVERNRRKQMNEYLAVLRSLMPASYVQRGDQASIIGGAINYVKEMEQLLQSLEAHRHARRARTDAAAALPFAGFFTFPQYSMSAVPTTTTTTVAAAATENGNAVAGAGAGDDADADVSGSKPSSVADIEVTMVESHANLKVLSRRRPRQLLRMVAGLQHHRLAVLHLNVASAGHMALYSLSLKVEEDCQLTSVDDIAAAVHGIVETIEQEQQQQQKQSCS

SEQ ID NO: 8652 - protein, 474 aa, Epymenia obtusa
RYESGVIPYAKMGYWDPDYVVKDTDILALFRVTPQPGVDPIEASAAVAGESSTATWTVVWTDLLTACDLYRAKAYKVDSVPNSSEQYFAYVAYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEAVNRSIAATGEVKGHYMNVTAATMEEIYERAEFAKQLGTVIVMIDLVIGYTAIQTMGIWARKNDMILHLHRAGNSTYSRQKSHGMNFRVICKWMRMAGVDHIHAGTVVGKLEGDPLMIRGFYNTLLVTHLDVNLPQGIFFEQDWASLRKVTPVASGGIHCGQMHQLLDYLGDDVVLQFGGGTIGHPDGIQAGATANRVALESIVIARNEGRDYVAEGPQILQNAAKTCGPLQTALDLWKDITFNYTSTDTADFVETPTANV

SEQ ID NO: 8653 - protein, 410 aa, Rhodobacter sphaeroides
MSAETTPPPLLDIEAATRLARALVSPIAEAETVPLAQASGRVAARRISAPRALPAADRSAMDGFALRAGDPGEGGTLPVAGTIAAGEPRRALSEGASLRIFTGALLPEGADAVVPLEDCIEEGGRLRLRHPAKAGDHVRRAGSEQPEGGTLLRSGARVRPQHVGLLAANGIGALAVVRRPRLGILSTGDELGRDGQGPEGIPDSNRPMLIALAEAAGAEVEDLGILPDDRDALVARLQALGGRHDLLVTSGAVSMGGRDHLRPALEAAGGTVEGWRVALKPGKPVLFGRLGPTAVTALPGHPLAAFVTFHLFVAAQIAQMLRLPWTPLFTEPARSGFDGLRKPGRAEVVPVRMGHGQVQGVPILRRLGEGGSGSLYPLAEADGLALVPSHLDRIRTGDRLHWYRFACGRG

SEQ ID NO: 8654 - protein, 253 aa, Oryza sativa; identical to SEQ ID NO: 7171

SEQ ID NO: 8655 - protein, 485 aa, Porphyromonas gulae
MEKNKLTTAAGAPVADNQNVATAGKRGPMLLQDVWFLEKLAHFDREVIPERRMHAKGSGAFGTFTVTHDITKYTKAAIFSEIGKQTELFVRFSTVAGERGAADAERDIRGFAIKFYTEEGNWDLVGNNTPVFFLRDPLKFPDLNHVVKRDPRTNMRSPQNNWDFWTLLPEALHQVTITMSDRGIPASYRHMHGYGSHAFSFINAEGVRHWVKFHLHTQQGIKNLTDAEAEALIGKDRESHQRDLFESIERGDYPRWTLKVQIMTEEEAKALPYNPFDLTKVWSQKDFPLIEVGVMELNRNPENYFADVEQSAFNPANVVPGISFSPDRMLQGRLFSYGDTQRYRLGVNHHQIPVNRSRCPFLNMYHRDGAMRVDGNFGSRLGYEPNSYGHWQDQNEYKEPPLELDGAAYQWDFREDDSDYYSQPRKLFHIMSPDQQQVLFDNTARAMGDIPKEIKLRHIANCYKADPDYGKGVAKALGLDVNEAL

SEQ ID NO: 8656 - protein, 512 aa, Burkholderia fungorum
MSFVSAVLYDMRQESFSMTGHLPKLSMYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWISTAEEIENPFVIG

SEQ ID NO: 8657 - protein, 406 aa, Xanthomonas axonopodis pv. citri str. 306
MTDYPSRIPYAQALQILHSVATSNRSPDENIAISRADGRISAGDLIAPLALPPFANSAMDGFALRHADIAAGDASLQLVGEQFAGERWAGTLAAGQCLRITTGAPLPDGADTVIPKEDADERDGMVRFQTAPAPGAAVRLAGSDVRAGDLVIQAGQVLTPARIGLAAALGVSRLAVAPRPTIAVLATGDELIEPGMPLGPGQIYNSNRDMLMAQLRALGYAPTAWPTLPDDPQRIGTMLEDAAAAFDVVITCGGVSAGEKDYLPRLIGELGRIHFWRVRMRPGMPAVLGQIGRCLVLGLPGNPVSVLATLIAYGVPLLDGLQGRSEPHPVWHAALASPWEKRHERLEFLRGRLECGEDGRLTALPHRGDASHLLRGAADSNALIVLPEQARRFEAGEIVRVIPYAL

SEQ ID NO: 8658 - protein, 480 aa, Chondrus nipponicus
ARIKDERYESGVIPYAKMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGVDVVLQFGGGTIGHPDGIQAGATANRVALESMVIARNEGRDFVAEGPQILQDAAKTCGPLQTALDLWKDISFNYTSTDTADFVETPTANV

SEQ ID NO: 8659 - protein, 213 aa, Glycine max
KGNSRVDPRVRGNTEKLMNQIMELKFTSKSLQRQSRKCEKEEKSEKLKVKKAIEKGNMDGARIYAENAIRKRTEQMNYLRLASRLDAVVARLDTQAKMTTISKSMGNIVKSLESSLATGNLQKMSETMDSFEKQFVNMEVQAEFMESAMAGSTSLSTPEGEVNSLMQQVADDYGLEVSVGLPQPAAHAVPAKEADKVDEDDLSRRLAELKGRG

SEQ ID NO: 8660 - protein, 491 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIAVRRRVAHPKVSPELRAIWVNYLSQCDESLGVKIANRLNVKPSM

SEQ ID NO: 8661 - protein, 500 aa, ASPERGILLUS NIDULANS FGSC A4
MYRINNIYVLAAFGTIGGALFGFDVSSMSAFLATDQYLEFFNHPNSDLQGGITASMSAGSFAGAIAAGFIADHVGRRKSLMVASLVWIIGAVIQCSAQNVAHLVAGRVISGLSVGVTSSQVCVYLAELAPARIRGRIVGIQQWAIEWGILIMYLISWGCGKGIAGPSAFRVAWGVQAVPGLVLFLALFFFPESPRWLASRERWEEALDVLAALHGKGNRNDPVVQVEFEEVKEAARLAAEAKDVSFFALFGPRIWKRTLCGVSCQVWQQLLGGNVAMYYVVWIFQMAGMYVIFVATTGVILPYIDRIGRRLLLVSGAIICMIIHYAIAAVMATRGNPVDEINGNASLKWEITGASGKAVIAMSYIFVGVYGLTWAPAAWIYASEVFPLKYRAKGVGLSAAGNWIFNFALAYFVAPAFTNIQWKTYIIFGVFCTVMTFHVFFMYPETAQRSLEEIDLMFDTHVKPWQTAKLQDRFEEEVERQRKQSVAEAHVGDASHKEEV

SEQ ID NO: 8662 - protein, 840 aa, Glycine max
SKAFLLGTSVRCAVFKEDVNAAILDGKEIDVSFDNFPYYLSENTKNVLVAACFMHLRHKEHEKFTADLTTINPRILLSGPAGSEIYQEMLVKALAKYFGAKLLIFDSHLLLGGLSSKEAELLKDGLNAEKSFGCTKLSPTEDMARIMDPLASEIETPSPSNAPTSYGFESQPKLETDNMPSTSGTAKSCSFKLGDRVKFSCSSSCGVYQTSPRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKERAAALAEGQPAPALCSSGDVRSLNMEDFKYAHQQVCASVSSESVNMTELLQWNELYGEGGSRVKKALSYFM

SEQ ID NO: 8663 - protein, 159 aa, Brucella melitensis 16M
MVEPKGFTITTTSFRRPYLEVMPVNAKAACLYPNNARMLREAKAKGFHNALVTDVLGNVAETATSNVFMVRGGEVFTPVPNGTFLNGITRQRVIKLLREAGVSVHETTLKIEDFREADEIFSTGNMSKVVPIIGFDERKLDYGLVTKRARALYWEWAHA

SEQ ID NO: 8664 - protein, 510 aa, Zea mays
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGSRANNVIKGTKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENILRACVGLAPENNMILEYK

SEQ ID NO: 8665 - protein, 472 aa, Prochlorococcus marinus subsp. pastoris str. CCMP1378
MPKAHFGLIGLGVMGENLVLNAERNGFSSVVFNRTYSKTQEFLEGRGLGKNVEGAKTLQEFVNKLERPRRILMMVKAGAATDAVIDNISEYLEEGDLLIDGGNSQFKDTERRVATLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMAEVFGLWNNTDELASYLVEITQICLNTKDELTGEDVVEKILDKAGQKGTGLWTVVSALELGISVPTIYASLNARVMSSLKVQRSEIEKTIPMEAIEDFDLGEISNGMKPLFDAVVLATIASYAQGMDILSEASSVYNYELNMPSIAQIWKGGCIIRSKLLKKIQDAYQKDPNLKNLIFDDWFNNEISTRIDNLASVVSSSTKAGIPVPCLSSTLDYLNSYRTNRLPQNLVQAMRDCFGSHTYERVDKEGSFHTEWMK

SEQ ID NO: 8666 - protein, 322 aa, Bacillus licheniformis
MNKKVALITTGGTIASRKTESGRLAAGAISGPELAEMCSLPEDVQIDVYPAFQLPSMHITFQHLLELKQTIERVFQDGGYDGAVVTHGTDTLEETAYFLDLTIEDERPVVVTGSQRAPEQQGTDAYTNIRHAVYTACSPDIKGAGTVVVFNERIFNARYVKKVHASNLQGFDVFGFGYLGIIDNDKVYVYQKLLKRDVHQLQRPLPAVDIVKCYLDGDGKFIRAAVREGVEGIVLEGVGRGQVPPNMMADIEQALNQGVYIVITTSAEEGEVYTTYDYAGSSYDLAKKGVILGKDYDSKKARMKLAVLLASYKEGIKDKFCY

SEQ ID NO: 8667 - protein, 651 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGSNATKPEEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 8668 - protein, 420 aa, Arabidopsis thaliana
MALSSLLRSAATSAAAPRVELYPSSSYNHSQVTSSLGFSHSLTSSRFSGAAVSTGKYSAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 8669 - protein, 58 aa, Glycine max
  unsure (1)..(58): unsure at all Xaa locations
EDSLLAAPIVLDXVLVAELSTIVELIADNEGEFHSVHAVATILRLLTRAPAGAPGLHW

SEQ ID NO: 8670 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 8671 - protein, 472 aa, Pisum sativum
PQQLDTPGTSNDHFMHTSNAGPFFAVSENYVHPPPSSSNYDRHAFHVDSGFIDLTMGSGRGHHKRKSPGIPSVYERGSSSGYFNAGSSTDLPTPPESWPEKPNMNSQYLPWDHVAMTPTFRGAGLSMKGESSVRNVRSRSALDLESNLSRTHLPINHSLNSYLTASPFGHCSLADLSAQVTTPLTRDWSQMNVTPANGRVLLPDASTSGLETSHFPVGNAATASSNAPADVGSFHHEFGTSRNPTTAQSFQNLTQPARGTRSNYSQRSTPAFRASSNLRMSHAVPSDNGLPMVAEGYSSRHPRPLTTVGWRNGDRNGRSRISSERYRSLADEAGLHARFSSEVPGFMIVERASLYGSRNILDQHRDMRMDVDNMSYEELLALGERIGQVNTGLSEDVLSKCLTETIYCSSDQCQDEGSCVICLEEYKNMDDVGTLKTCGHDYHVSCIKKWLSMKKLCPICKSSVLPEDKKDK

SEQ ID NO: 8672 - protein, 354 aa, Blumeria graminis
MGCGLSTEEKEKKARNEEIENQLKRDKILQRNEIKMLLLGAGESGKSTILKQMKLIHEGGYSRDERESFKEIIFSNTEQSMRVILEAMESLELPLDDQKAEYHVQTIFMQPAQIEGDNLPPEVGTAISALWTDAGVQDCFKRSREYQLNDSARYYFDNIDRIAQPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDFEGGDDYALACDYILNRFVSLNHHETKQIYTHFTCATDTTQIRFVMAAVNLDIIIQENLRLCGLI

SEQ ID NO: 8673 - protein, 731 aa, Oryza sativa
MLETAKKFKEIFSETTTNSQEITAEANKQADLLVNQIKHLTTDLPVPSIPAIPHIPSAVTPKPDAAKLEHYGIIEDLREFVKGMTTLPTPSSRVNADNLLHATASRHRLHSVASRAVDTQLSSPGARTLSHRATPSMPSAAPARAHAHLRLTGPATNVVTDDEEERERIGEKEGCHINTMYVPHSRSDDVSVTSPDMASGPHPPTAMGPATNPGVVLCNFSPLPSTQPLAQCHVTSLRMRSTRALRASSFSPNEIFYKDMMATVCEERYSAVSDLVGCGFEEEGYPVVDYDLAYILVSKIPILCKYRNRDIKCRQNPNMKRIVNNSARESESATALLVLVLFLLPNPIHPLAAAAAAASCVACSCPETMGSLAAEKTVTGWAARDASGHLTPYNYTLRKTGPEDVVVKVLYCGICHTDIHQAKNHLGASKYPMVPGHEVVGEVVEVGPEVTKYSAGDVVGVGVIVGCCRECHPCKANVEQYCNKRIWSYNDVYTDGRPTQGGFASAMVVDQKFVVKIPAGLAPEQAAPLLCAGLTVYSPLKHFGLMSPGLRGGVLGLGGVGHMGVKVAKSMGHHVTVISSSARKRGEAMDDLGADAYLVSSDAAAMAAAGDSLDYIIDTVPVHHPLEPYLALLKLDGKLILMGVINQPLSFISPMVMLGRKAITGSFIGSMAETEEVLNFCVDKGLTSQIEVVKMDYVNQALERLERNDVRYRFVVDVAGSNIDDADAPPA

SEQ ID NO: 8674 - protein, 118 aa, Triticum aestivum
  unsure (1)..(118): unsure at all Xaa locations
PTRTRTRGVSSYRNHVHALYMGVPSSPVIAKLFSNANRCSRGQGGSMHMCSEPHTLLGGFNLIDEGIPVRTVTNFSAKYRHXVLKQCSPVGLDVTLEFFGDGTCNISQFFESLDMDHL

SEQ ID NO: 8675 - protein, 440 aa, Ferroplasma acidarmanus
MKDKKFISVPVATAVGLGAIIGAGIFVLSGTTIALAGANALIAFVLVGVLAIIIAMELGELGSIMPHAKGASFSYIYEAFGSEMGFITGILLYFSFSTAIAAIALGFGSYLGSLVGLHTGYYPIIFAIILIFVLAIVNIVGIKKAAKADFYLVMVKLAILTIFVIAAVILAYTTKSLNTSNFVTPVAKDNISAIFAASIAVFFAYSGFQSISTFTSDIKGGANKAAKAIILSVLISMVFYILVVLALILMVPASKYTISADPLAFALKYVHAPYSIYALVTIGALIATTSATLAMIMTSSRILYQIGDNKLLPKFFRKFNYKKDVSVNGVIISSLIGIVMLFSGNIYIIAAISNFGLLLSYLVASFAIIHFRRIKKFGSFKTPLYPFTIIAGIILLIVFILGMPREALDIGVVIILLLFMLYYFFIELRRDKVIKEELFK

SEQ ID NO: 8676 - protein, 204 aa, Xylella fastidiosa Temecula1
MHLISNDFKNGQPIPVECAAGQTDGFAPNRNPHLAWDNVPENTRSFALLCIDPDVPSIPETIGRTDMEIPVTQPRIDFVHWVMTDISTDLRMIAHGSCSDGFVVGGKTMPPGPAGTHQGLNDYTKFFANTPEMAGDYYGYDGPYPPFNDLRIHRYLFRLFALDLEHLPLHKRFDGPTLLRTIQGHVLTEATLYGTYTLNPKAQK

SEQ ID NO: 8677 - protein, 382 aa, Spinacia oleracea
MPSRPSRVVKEQHPTKKSFLDLESLNELPDSFAWGSFEDPCSIDNPSGYGPDSVPVINLQDPQAQQLVGLACRSWGVFQVTNHGIQKSLLDDIEAAGKSLFALPVNQKLKAARSSCGVTGYGPAGISSFFPKRMWSEGFTILGSPLDHARQLWPNNYNKFCDIIEKYQKEMNQLAKKLMQLVVGSLGISNQDIMNWADLLEGANGAMQLNSYPIRPDPNRAMGLAAHTDSTLLTILHQSNTTGLQVFRERSGWVTVPPISGGLVINIGDLLHILSNGRYPSVYHRAMVNRVQHRLSVAYLYGPASGVRVQPLPKLIDATHPPLYRPVTWSEYLGIKSEHLTKALSLIRINHNTNPSLTGLIGNDEPKSINVDSDKTILAVFG

SEQ ID NO: 8678 - protein, 510 aa, Neurospora crassa
MNGIKDLGLGFSKASTRLHFFSLLLALGSFVWGYNVGVLASVLAHPGFRETIPGYGPYKRGLITSINYLGTWLSYIFFSRPATDLLGRRYAAMVGMSVLCVGQALQAAASGSVALSMVIFGRVVSGLGTGIVSTSVPLYQSEIAPAKQRGRLVVLNHVGFVAGLASGFCSHGYLSGWRLSVSLSFIPALIFFVGLPFLHESPRWLVEHGRPDEALKALQFYREGSFTPSQIQSELTDIKRNVCAYQATSLKKWTSLFTNPSLFTRLWRAALLHFMAQMCGATAMKYYLPDLFRVLGLSPRVSLLAGGIESTLKIGCTVLEMFVIDKVGRRMTLAVGAGIMAFALLINGALPLAYPNNTNRASDYTCVVFIFIYSLGYSMGFGPAAWVYGSEIFPTAARARGLSFAASGGAVGSIIVSQLWPIGIAELGSKIYFFFMAVNLACVPIIFLLYPETKGRPLEDMEVLFGGYEGGTPSTTSLLLADEREDGNEEDEENETLGRPLLGDGRGMAR

SEQ ID NO: 8679 - protein, 561 aa, Methanothermobacter thermautotrophicus str. Delta H
MINMNIGPYNNRPDMGRLREIIRVMTKYHFGNILEAVGLKNRLFETLKLYIKSPEEVHEPAHVRLRLVLEELGTTFIKLGQVLSTRADLVGREVAEELAKLQDEAPPFPFEDVKRVLESELGVPMEEVFAEFQEEPVASASIGQVHRARLRNGDAVAVKVQRPGIADTVKSDIILMKYLAKLANDRVPGLRYYNLPGIVAEFERAIRKELDYHQEANNVERFRAMFMDDETVYAPYVYREYSTGRVLTMEYVDGVKLTDILKSDIKFNARVIAERGARCYFKQIFIHGFFHADPHPGNILVQKGNVLCFLDFGMMGHLDRSFRDRLAELFILLMNYDVNGIVNQLRYMNILTEETDLEEVKYDIIDLLDRYYGADVRKVGEILTEFTMPGMIRRHRIRIPRDFVLLARVMSMAEDLGERLDPRFNGLAVAWEMTHKLIRNRLNPLRNLDEVPAAIIELEHIMNDLPRGLISALQKLEEGKLKMELEHRNLDEISVRIERSTNRISVAMLVSALIIGSSLVTIPREALILEKFPFLGIFGFAVSFLIALALIVSIIKSRRLS

SEQ ID NO: 8680 - protein, 337 aa, Zea mays; identical to SEQ ID NO: 2954

SEQ ID NO: 8681 - protein, 360 aa, Schedonorus arundinaceus
MGSSAADVAASADEEACMYALQLGSSSILPMTLKNTIELGLLETLMAAGGKSLTPTEVAAKLPCAANPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLELYDGFQGIGTLVDVGGSVGATVAAITAHYPAIEGINFDLPHVISEAPPFPGVTHVGGDMFKKVPSGDAILMKWILHDWSDQHCATLLKNCYDALPAHGKVVLVECILPVHPEAKPSSQGVFHVDMIMLAHNPGGRERYEREFEALAKGAGFAGFKSTYIYANAWAIEFTK

SEQ ID NO: 8682 - protein, 195 aa, Oryza sativa
  unsure (1)..(195): unsure at all Xaa locations
MAFASSLLPAPPASVAPELASFLPPQAKRGAVSLAATRRRGARIGVRAEVNESGSALAADAFAQVKHVLLPVTDRNPYLSEGTRQAAATSASLAKKYGANITVVVIDDKPKEEFPEHDTQMSSIRWHLSEGGFTEFGLMERXLGEGKKPTAIIGEVADELELDLVVLSMEAIHSKHVDGNLLAEFIPCPVLLLPL

SEQ ID NO: 8683 - protein, 414 aa, Desulfitobacterium hafniense
MVEMSLRENALKLHADHRGKIKIALKVPCRDYNDLSLAYSPGVAEPCMEIAQDPELVNTYTNRANCVAVVSNGTAVLGLGDIGARAAMPVMEGKSLLFKNFAGVDSFPICLDTKNIDKIVEVVKLLEPTFGGINLEDIKAPECFEIEEKLKAVYDGPVFHDDQHGTAVVTLAAMFNALKIVNKELKDVKIVTSGAGAAGMAIVKLLMDCGLQNVIMCDTKGTIYKGRAEGMNKYKEEIALRTNPAMVKGSLGEALKGADVFIGISVGNTVTQEMIRTMAKDAIVFAQANPVPEIMPEEAKEAGAAVIGTGRSDYPNQINNILSFPGIFRGTFDVEAREINGPMKIAAAEAIASIVSPEELSAEYIIPKAFDKRVAPAVAAAVAKAAMESGVAKRKVDPEQVALNLTSLLAQEGK

SEQ ID NO: 8684 - protein, 213 aa, Magnetospirillum magnetotacticum
MTVKIAPSILSADFARLGEEVKAIDEAGCDWVHIDVMDGHFVPNLTFGPAIIKAIRPYTTKVFDVHLMIDPAQPYIEDYAKAGADIIVVHAEADKHLDRSLQLIRSLGKKAGVSLNPATPESVIEYVMDKLDLVLVMSVNPGFGGQSFIEAQLDKITRIKKMIGHRMIDLEVDGGVTADNAHRVAAAGANVLVAGSAVFKTKDYAANIAALRR

SEQ ID NO: 8685 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKLRVPTLKELTIMCRNAYDEEMFVQMEMHILSTLDWSIGHPTLEDCLQLAIDLNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQLDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 8686 - protein, 468 aa, Agarum clathratum
IRYAKMGYWDADYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNVTAATMEQMYERAEYAYSIGTVIVMIDLVVGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAAATCGPLKAALDLWKDITFEYTSTDTPDFVESTTESN

SEQ ID NO: 8687 - protein, 351 aa, Ipomoea hederacea
ERLASSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDN

SEQ ID NO: 8688 - protein, 469 aa, Xanthomonas campestris pv. campestris str. ATCC 33913
MSVENVEKLIKDNKVEFVDLRFVDMRGVQQHITFPASIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFANSGTNSYKRLVPGYEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 8689 - protein, 310 aa, Pseudomonas syringae pv. syringae B728a
MNPYLSIAPSVSRPAWHQAIPLPLLEAALVLTWSSGFVGARFSLDHAPPLLVVFWRCVVVTLILLPFVARQLRSIPAATLLKNAGIGLLAMTGYVAGVTQGIALGVPAGLAALFADLLPMGMALLAAVVLGQRLAWPIWAGLFVGLIGVVLVTYSALAVGDAPLWAYGLPLLGMFSLAIATLWQKQSGTAQPMALLPNLWLQCAVSSVAFAIIQGTQGRLAPVASTGFALSVLWTVGLATLGGYGLYWVCLRRASATRVASVLYLSPPVTMLWAWAMFDEPLSWQMASGMAVSGIGVWMVVRAEQRQSAS

SEQ ID NO: 8690 - protein, 402 aa, Aquifex aeolicus VF5
MKNLTPLEEALKIVLENVKPLESERVFIHEALGRVLAEDVVSDTDKPLFDNSAMDGYAVRWEDIKEVPAKLKVIGEYAAGTGENLKVEKGTAVKIFTGAPIPEGADTVVPVEYTETQDGYVIVKKSFKQGANVRRRGEDVKKGEVVIPKGKEIRPYEMGMLASVNRAVVSVYRKPHVGILSTGDEILDVCEEQTKPSQIRTSNNYTVYGQVLQAGGIPHNLGIAPDEPQKLKEIMRSIHKYDIFITTGGVSMGEKDYVQYLVEDLGIDVKFHKLRIKPAKPVLFGVYGENKLFFGLPGNPVSAAVAFDLLVYPAIKAMQGHREVFKQKVTAILEGDYRRKNADRREFARCRVWFENGRYHCEPYPKQDSHMLTSLVNSNAYMVVYEGVNELKKGQEVEVILF

SEQ ID NO: 8691 - protein, 215 aa, Sodalis glossinidius
MSAQQQAVILAHCRQHGIWIVSDEVYSRIVFDGPPEGCAPSFLDIADPDDRLLVINSFSKSWLMTGWRLGWVVAPPALMYELGKLIEYNSSCAPGFVQKAGLVAVNQGEAVRQETVALFQASRDYLYQRLGTLPDIEVPLPAGAIYLFFRVRGLDDSLAFCKALVAEAGVGLAPGSAFGDAGEGCLRWCIASSIEKLEQGADRFSRFLHRSPLRR

SEQ ID NO: 8692 - protein, 175 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 8693 - protein, 200 aa, Streptomyces coelicolor A3(2)
MSAPTGTRAGAAPRVAVIDNYDSFTYNLVHYVAELGGRPTVFRNDAVTVAELAGFDLLLLSPGPGTPAGAGICVDAVRALGARLPVLGVCLGHQAVAVAYGGSVVRGEQVHGKASAVHHDGGGVFAGLPDPFSATRYHSLVVEPAGLPDELTVTARTADGTVMGLRHRTHPVHGVQFHPESVLSPEGKQLIANFLECADD

SEQ ID NO: 8694 - protein, 275 aa, Glycine max
MSSMLRFPFSFPQPRRPQFPRPFTAFAAAVAGASAAVVAVSSSDRSFLRNALNSFFSSDLSMPLWGSLSLADSGVSVVESKTGTSFPSVLDSSQKLCGIGLRKKSILGLKNIDVYAFGVYADDEDIKRHLSEKYGKLSASELQGSKEFTEDLMESDISMTIRLQIVYGRLSIRSVRSAFEESVGSRLQKFGGSDNKELLQSFTSQFKDEFKIPRGSVIHLSRDKGHVLRTSIDGQEVGSIQSKLLCKSILDLYFGEEPFDKQAKEEIELNMASYL

SEQ ID NO: 8695 - protein, 324 aa, Prochlorococcus marinus subsp. pastoris str. CCMP1378
MPIQSIKNDKILEKINSLKILNNFENQNLDHFNQFKIALHIRAIEEAIVSLAKDNKLRGPIHSYVGEEAIATGVLSHAKPIDAVTSTHRGHGHYIAKGGNISMLIDELHGKESGCNGGKGGSMHVADLSINHFGANGIVGGGVPIACGIALANKLDKKDSIVFCFFGDGASNQGVVLESFNLAGFLSLPIVFICENNQFAQSTKLSDISLTSVAKKSQGFGIKSIEVDGLNISEVYSKTSDAVNYTRNEIKPYLIQANTYRFHRHFVSEKPKPIDYLDENFHKEFLSKDPIINYCYRNKIDFIVLEDYLTNIKDIIFNYSKNIS

SEQ ID NO: 8696 - protein, 189 aa, Oryza sativa
  unsure (1)..(189): unsure at all Xaa locations
MWSAGCPSNLALLALPPFLERVSSPAWPSLLSVLAQLPVFVRCQRVRKELHEDIMVPDYCYAGGGELQSLNAWFGPHGTVTPLHHDPHHNILAQVLGRKYIRLYPASISEDLYPHTETMLSNTSQVDLDNVDLKEFPRVENLDFLDCILEEGDLLYIPPKWWHYVRSLSISLXSVSFWWRSTVVPSKGS

SEQ ID NO: 8697 - protein, 486 aa, Zea mays
  unsure (1)..(486): unsure at all Xaa locations
MGIQGNKAATHEHDFLSLYAAAAAKDAPLLLHDSKAPPPSQGNFLLKTHDFLQPLDQKPGAPPEPSPLPASAAESRHQPQQQVVVANQHALPLPGGVGTFSISPAPVSVALPAAVVKSEPPFVLWGQPAATLHPGARGHQQQWALPFAGAGQVRLPPQQAPPDRKGRGGAGGGVMESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWKWIFPXGSNFTGKLDDNHNIVTSAAASGAQDQAETDHMASGCYRSAETTANFTNNAMSQSQPQWTGPSPVDDCAVNSETLNNQQLVIDEGTIRVSSNYSQELLNSLTHALQSSGVDLSQANISVQINMGKRAVKRPAAGVSTNSKEPADPASSNELGHQLTLSGGGAGADGLSHATKRHKRGSS

SEQ ID NO: 8698 - protein, 232 aa, Mycobacterium tuberculosis H37Rv
MSLMAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 8699 - protein, 197 aa, Corynebacterium efficiens YS-314
MTETDMDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 8700 - protein, 505 aa, Bradyrhizobium japonicum USDA 110
MNKVEFLSVTKVPFAERYDNFIGGKFVAPISGKYFDNASPVNGQIVCKIARSDAQDVEAALDAAHAAKAGWGSTSVAERAAILNKIADRMEENLERLAIAETWDNGKPIRETRAADIPLAIDHFRYFAGVVRAQEGSIGEIDHDTIAYHFHEPLGVVGQIIPWNFPLLMACWKLAPALAAGNCVVLKPAEQTPASIMVWAEIIGDLLPPGVLNIVNGFGLEAGKPLASSPRIAKIAFTGETSTGRLIMQYASQNLIPVTLELGGKSPNIFFKDVTAEDDDFFDKAIEGFVMFALNQGEVCTCPSRALVHADIYDRFMERALKRVAAIKQGDPRAADTMIGAQASGEQLAKILSYIDIGKQEGAKVLAGGGRAELGGDLSGGFYVQPTVFEGHNKMRIFQEEIFGPVVSVTTFKTDDEALAIANDTLYGLGAGVWSRDANRCYRFGRAIQAGRVWTNCYHAYPAHAAFGGYKQSGVGRETHKMMLDHYQQTKNLLVSYSPKKLGFF

SEQ ID NO: 8701 - protein, 408 aa, Saccharomyces cerevisiae
MSNDEGETFATEQTTQQVFQKLGSNMENRVCFDCGNKNPTWTSVPFGVMLCIQCSAVHRNMGVHITFVKSSTLDKWTINNLRRFKLGGNHKARDFFLKNNGKQLLNTANVDAKTKYTSPVAKKYKIHLDKKVQKDMELYPSELVLNGQDSSDSPLDTDSDASRSTSKENSVDDFFSNWQKPSSNSSSKLNVNTGSLAPKNNTTGSTPKTTVTKTRSSILTACRKKPVLNSQDKKKHSILSSSRKPTRLTAKKVDKSQAEDLFDQFKKEAQQEKEDEFTNSSSSTKIRQNDYDSQFMNNSKGNNNNSIDDINTQPDEFNDFLNDTSNSFDTTRKEQQDTLTPKFAKLGFGMTMNDANDLAKQQKESQKIAQGPRYTGRIAERYGTQKAISSDQLFGRGSFDEAANRGSA

SEQ ID NO: 8702 - protein, 377 aa, Yersinia pestis KIM
MPAQNPLQHQRQHDGIYHIGYFVGGKWSQAQEQFDVYNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGIAMRWAVISSSQR

SEQ ID NO: 8703 - protein, 405 aa, Triticum aestivum
THASGLLLRRGRRRGVCGAAAAGDGRPRRRRQLPRVQSPPLHFQPQEDFLKLTVPHFKGKEDVGLVQARWSFVNKDENLLTRLQNINLCFHFEVEQQVNGAFLNFFGFNGTAGVWRIKALEDSGGWMERTTVEDMDIAVRAHLKGWKFLYLNDVECQCELPESYEAYRKQQHRWHSGPMQLFRLCFVDIIKSKIGFWKKFNLIFLFFLLRKLILPFYSFTLFCVILPMTMFAPEAELPAWVVCYIPATMSLLNILPAPKSFPFIVPYLLFENTMSVTKFNAMISGLFQLGSAYEWVVTKKSGRSSEGDLVALVENEKQSKQQRVGSAPNLDSLAAKEECTPKSESEPKKKKHNRLYRKELALSFLLLTAAARSLLSVQGIHFYFLLFQGVSFLVVGLDLIGEQVE

SEQ ID NO: 8704 - protein, 222 aa, Pennisetum glaucum
IENKISRQVTFAKRRNGLLKKAYELSLLCDAEVALIIFSGRGRLFEFSSSSCMYKTLERYRSSNYGSQEVKTPSDGEINYQDYLELKTRVEFLQTTQRNILGEDLGPLSMKELEQVENQIEISLKHIKDKKNQMLLNQLFDLKSKEQELQDLNKDLRKKLQETNAESVLHLSWEEGGHSGTGGNAIEPYQGFLQHPENDPSLQIGYHQQAYIDQLNNEDMAD

SEQ ID NO: 8705 - protein, 341 aa, Staphylococcus aureus subsp. aureus Mu50
MSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSTMVMSGNKVKVIAWYDNEWGYSNRVVDVAEQIGALLTSKETVSAS

SEQ ID NO: 8706 - protein, 320 aa, Zea mays
MGILALITGKAGASGFGSASTAEQVTDGADASRLTVAITGGASGIGLETSRVFALRGAHVVIAARNTEAASEARKTIMEKNPTARIDVLKLDLSSLKSVRAFVDRFNSMKLPLNILINNAGVMFCPFQLSKDGVEMQFATNHLGHFLLTNLLLDTMKATAKSTGIEGRIVNLSSVAHHHTYPKGIDFDNLNDEKKYNDKMAYGQSKLANLLHAKELSRRLKEEGENITVNSVHPGLIMTNLMRHSFVLMKVLQVATYILWKNVPQGAATTCYVGLSPQLKGVTGKYFADCNVEKTSKMARSEELAKRLWDFSEELIKSAK

SEQ ID NO: 8707 - protein, 335 aa, Chlamydophila caviae GPIC
MKVVINGFGRIGRLVLRQVLKRNSSVDVVAVNDLVPGEALTYLFKYDSTHGRFPADVSYDNGYLVVDGRRIQLLDQRDVQKLPWKDLGVDVVIESTGLFTKKEDAAKHLDSGAKRVLITAPAKGDVPTFVMGVNENAFDPEKDTIISNASCTTNCLAPLAKVLLDNFGIEEGLMTTVHAATATQSVVDGPSKKDWRGGRGAFQNIVPASTGAAKAVALCLPELKNKLTGMAFRVPVADVSVVDLTVRLQKSTTYEEICKAIKNASETNLRGILGYTDQEVVSSDFIGCEYSSIFDAGAGIALTDRFFKLVAWYDNEIGYATRIVDLLEYVAKNSK

SEQ ID NO: 8708 - protein, 348 aa, Azotobacter vinelandii
MPNPPYRVALNGYGRIGRCVLRAHYERGASSAFRIVALNDLADQASIEYLTRFDSTHGRFPGEVRVEGDRLCLNGDSLRVLRASTPEAVDWRSLGIDLVLECSGVYHSRADGERFLRAGAPRVLFSQPMASEHDVDATIVYGINQQRLTGDERLVSNASCTTNCSVPLLKSLNEAIGLEYVSITTIHSAMNDQPVIDAYHHEDLRRTRSAFQSVIPVSTGLARGIERLLPELSGRIQAKAVRVPTLNVSCLDITLQTARDTSAEEVNRVLRQAAGQGPLKGLLDYTELPHASCDFNHDPHSAIVDGSQTRVSGPRLVNLLAWFDNEWGFANRMLDVAGHWLGVAAARR

SEQ ID NO: 8709 - protein, 200 aa, Pseudomonas aeruginosa UCBPP-PA14
MESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 8710 - protein, 136 aa, Glycine max
  unsure (1)..(136): unsure at all Xaa locations
MLLARISHRCIGSTLTKPFSAVISTTDTPLTIETSIHSTAHNCEPPSRAVATSWGELLTFFLDMALMRRMEIAADSLYKAKLIRGFCHLYDGQEAVAVGMEAAITKMDSIITAYXDHCTFLGRGGTLLEGSAELMG

SEQ ID NO: 8711 - protein, 431 aa, Salmonella typhimurium LT2
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 8712 - protein, 337 aa, Agaricus bisporus
MVNVGINGFGRIGRLVLRNALQMQILTVVAVNDPFLDVEYMAYLFKYDSVHGRYQGKVETKDGKLIIDGHKIAAFAEREPANIKWADCGAEYIVESTGVFKTEELAKEHLKGGAKKVVITAPGSGVPTYVVGVNLDKYDPKEVVISNASCTTNCLAVLAKVINDKFGIVEGLMTTVHATTATQKTVDAPAKKDWRSGRSVTNNIIPASTGAAKAVTKAIPDLEGKLTGLAFRVPTLDVSVVDLVVRLEKETSYDDVKKAMRDAADGKHPGIEKGIVDYTEEDVVSTDFVGSNYSMIFDAKAGIALNSRFMKLVAWYDNEWGYARRVCDEVVYVAKKN

SEQ ID NO: 8713 - protein, 355 aa, Cryphonectria parasitica
MSRSQAPNPAGSRKISFNVSEQYDIKDVVGEGAYCVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASQEDKSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTLFPKTSELALDLLEKLLAFNPVKRITVEEALKHPYLEPYHDPDDEPTAPPIPEEFFDFDKHKENLSKEQLKQLIYQEIMR

SEQ ID NO: 8714 - protein, 468 aa, Pseudomonas fluorescens PfO-1
MNSLNSKDLNGQLAQGFKPRHVTMLSIAGIIGAGLFVGSGHAIAAAGPAVLLAYLFSGLLVVLVMRMLGEMAVAHPDTGSFSTYADQAIGRWAGFTIGWLYWWFWVLVIPIEALAAGHVLNQWFPQVDAWLFALLSIILLVVTNLFSVSKYGEFEFWFAMAKVVAIIGFIGLGFAVLMGWIPGREASGLSRLMEEHGGFAPNGLSAVVGAFITIMFSFIGTEAVTIAAAESSNPAQNIAKATRSVIWRIGVFYLLSIFVVISVVPWNDPLLASVGSYQRALELMNIPNAKFLVDVVVLIAVASCMNSSIYISSRMLFSLGRRGDAPQPLKVTSAAGVPRAAVIASTVIGAGVTLFSYFMPGGLFQFLLASSGAIALLVYLVIAISQLRMRRMLRRQNVELTFRMWLFPWLTWLVIAFICAALAVMMVTPEHRLEVTSTIGLALTISFIGLVTTRQHGQMRAVVSAGKA

SEQ ID NO: 8715 - protein, 348 aa, Oryza sativa
MAMRKRMRGALLALALLLTATAVVPLLLLGEAGDDGVGAVAAAPPFNASRVRAVSWRPRVFVYKGFLSDDECDHLVKLMPPPWLNPICVSIDWCVWLEQGKRKMQRSMVADNKSGKSVMSEVRTSSGMFLDKRQDQCNSCCDAMPQLLNTFRSPSVVCCTNTEPGYPATGEHTGRQNAENIQILRYEHGQKYEPHFDYFHDKVNQALGGHRYATVLMYLSTVEKGGETVFPNAEASLIAVKPVKGDTVLFFSLHIDGVPDPLSLHGSCPVIEGEKWSAPKWIRIRSYEHPPVSKVTEGCSDNSARCAKWAEAGECEKNPVYMRTSLDPNKSFVLLHAKNRRISVHFQQ

SEQ ID NO: 8716 - protein, 505 aa, Hordeum brevisubulatum
MAAPPAIPRRGLFIGGGWREPTLGRHIPVINPATEATIGDIPAATAEDVELAVAAGGPVLARRREHWARASGAVRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKMIMTAAAQMVKPVSLELGGKSPLVIFDDVADIDKAVEWAMFGCFFNGGRVCSATSRLLLHEKIAARFLDRLVEWVKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDNLERCERIAKVIHSGIVWINCSQPTLVQAPWGGNKRSGFGRELGEWGLENYLSVKQVTRYCKDELYGWYQRPSKL

SEQ ID NO: 8717 - protein, 81 aa, Oryza sativa
  unsure (1)..(81): unsure at all Xaa locations
INLEIIEETKISRTLPXRPPTNVFRVKEDVRPIFWANRPKSYISRTLGWDQYPHWRWCDSRNPSYGALXTDYQFTRPPGKG

SEQ ID NO: 8718 - protein, 353 aa, Glycine max
  unsure (1)..(353): unsure at all Xaa locations
MEWHRGHTIGQGSSATVSTATCCGGVLAVKSTELPQSEPLKREQKILSSLSSPYVVAYKGCDITMENNKLLFNLFMEYMPFGTLAQAXTRRCAGRLXESVIARYTRQIVQGLDYLHSKGLVHCDIKGANILIGEDGAKIGDLGCAKSAADSTGAIGGTPMFMAPEVARGEEQGCASDIWSLGCTVIEMVTGGAPWPNVEDPFSVLYHIAYSSEVPEIPCFLSKEAKDFLGKCLRRNPQERWKASELLKHPFIEKLCFNKEVLESNTSSPTSVLEQGYWSCVEESESLGDLIHKTRKFETLAAGRVRMLALSSGVPYWARHDDENWITARGNGVEGFANCGAETASSASHGLSH

SEQ ID NO: 8719 - protein, 497 aa, Corynebacterium glutamicum ATCC 13032
MNAATRRASLQLPYTHVDDFYINGSWVKAEGTQRNPVVDPAVGQEWGSVPEATASELDSAVGAARTALKSWSALTGAERTGYLLKIATEIESRSEALALTNTRENGSPISETRGAASNAAGIFRYFATLAPWLDGEDIRPFPAGSAESIVDKDPIGVCALIAPWNFPINLVVIKLAPALLAGCTVIIKPASPTPLSIRFIIEAIEAAGVPAGVVNLLTGSGRFGDALVRHPGVDKVAFTGSTPVGKKIAAACGELLRPVTLELGGKSSAIILPDADMSVLSTRLIRSCMRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 8720 - protein, 210 aa, Oryza sativa
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIIWARCYLL

SEQ ID NO: 8721 - protein, 135 aa, Haemophilus influenzae
EDPTPALEGADVVLISAGVARKPGMDRSDLFNINAGIVRGLIEKVATICPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 8722 - protein, 391 aa, Cytophaga hutchinsonii
MIIPAANRLNVVKEYYFVRKLEEIAKLNKEGKNVISFGIGSPDLAPSEATVDALVATSRLSNAHGYQPYRGIPELRDSIASFYKNTYGVELDSNTEVLPLMGSKEGILHVSMAFLNPGDEVLVPDPGYPTYTSLTTLIGGVVRKYALSEKNNWHPDLEELKKQDLSKVKLMWLNYPHMPTGAEADRAQIEKIIAFAKEYKILLCFDNPYSLVLNQNKPFSILSIPGATEVAVEFNSLSKSHNMAGWRIGMMVGSPIYLNPALTVKSNIDSGMYLGLQKAAIEAFKNTEAWHAERNKIYADRREKIFGILDKLGFEYSRKQVGLFVWCKPKDAAAIGDIPAYVDRLLNEAYVFFTPGAIFGEKGEGYLRASLCVPIEKITEAEARIDAWLKK

SEQ ID NO: 8723 - protein, 500 aa, Escherichia coli O157:H7 EDL933
MLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEANFLDWGWRIPFFIALPLGIIGLYLRHALEETPAFQQHVDKLEQGDREGLQDGPKVSFKEIATKYWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMFPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 8724 - protein, 86 aa, Triticum aestivum
MAKHHPDLIMCRKQPGIAIGRLCEKCDGKCVICDSYVRPCTLVRVCDECNYGSFQGRCVICGGVGISDAYYCKECTQQEKDRDGCP

SEQ ID NO: 8725 - protein, 242 aa, Oryza sativa
  unsure (1)..(242): unsure at all Xaa locations
QVDTTVLGLPQDEAKEKPYIASMGVYIFKKEILLNLLRWRFPTANDFGSEIIPASAKEINVKAYLFNDYWEDIGTIKSFFEAXLSLAEQPPRFSFYDANKPMYTSRRNLPPSMINNSKITDSIISHGCFLDSCRKGPRVVGTRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 8726 - protein, 500 aa, GIBBERELLA ZEAE PH-1
MSLDIQLTAPNGRTYKQPTGLFINNEWVKSSNGEKITSINPTNEQEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFPPGVVNIINGLGTVAGAALASHMDVDKIAFTGSTPTARSIMKMASSNLKNITLETGGKSPLIVFDDADVDLAAYWAHAGIMYNQGQVCTATSRILVQESIYDKFMAAFGAQVKNISKVGDPFEESTFQGPQVTKAQYERILSFVDVGKKEGAKLALGGQPFKVGDGKGYFVEPTVFTDVTPKMRVFQEEVFGPFVVVTKFSSEDEAIHLANDTQYGLGSALFTTNLTRAHQVAKRIEAGMVWVNSSNDSDWRIPFGGVKQSGIGRELGEAGLAAYSNIKAVHVNIAAKL

SEQ ID NO: 8727 - protein, 218 aa, Gracilaria gracilis
SQTRILLAGAVGALVAATCRIPQEVLKQPLQAEIYPNVFVALKETVGKNGIGALYKGSIATISRDIPWNALSFMFHGQGKKMFKSTKGRDPANDENLVIAGVAGALAAIIMTPIDVVKTRIMTQRVGSTVYSGVIGTFSKIVREEGAGTLMKGVIPRIVFLAPLAGITFSVYEAVAANIKKRKTVAEPVAYNSLQEAFMTHLQPGLKERTRTTTLALR

SEQ ID NO: 8728 - protein, 522 aa, Zea mays
MERVAAAKKFIESHYRSQMKNIQERKERRFRLERQLASSQVPKEQQINLMKDLERKETEYMRLKRHKICVEDYELLTVTGDMRLKEHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIQSIHKHNYIHRDIKPDNLLLDKNGHMKLSDFGLCKPIDCSKLSTLNEDEPMGDDNMRESMDIDSSLSNTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFQGVAWDKLYEMEAAFKPQVNDELDTQNFMKFEELENPPAKTGSGPSRKMMLNSKDLSFVGYTYKNFDAVKAIKISDLQRNSSLTRPSIGSIFGPSGMDSPMEPNGRDTHMHTVSSGDPMIP

SEQ ID NO: 8729 - protein, 282 aa, Triticum aestivum
MEAAVGGSWTRVRTLGRGASGAVVSLAADDLLGALFAVKSAPAAAADQLRREGDILSGLSSPHVLPCLGFRAAAGECQLFLEFAPGGSVADVAERCGGRLEEGAVRAYAADVARGLAYLHGRSLVHGDVKARNVVVGADGRAKIADFVCARAVGSSDRPIGGTPAFMAPEVARGEEQGPAADVWALGCTVVEMATGRAPWSDMDDVLAAMHRIGYTDAVPEVPAWLSAEAKHFLALCFARDARRPGAHFVFGAPPPAHPLILRFRTKCLFLKERKAKCLVSK

SEQ ID NO: 8730 - protein, 466 aa, Arthrobacter sp.
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 8731 - protein, 181 aa, Shewanella oneidensis MR-1
MNTETLSLIKQSIKTIPNYPKEGILFRDVTSLLENATAYKATIDLLVEHYRSKGFTKIVGTEARGFLFGAPLALGLGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 8732 - protein, 409 aa, Corynebacterium glutamicum ATCC 13032
MVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 8733 - protein, 179 aa, Pseudomonas fluorescens PfO-1
MKAKADVPFVPLNIAVLTVSDTRTLETDTSGQVFVDRLTAAGHHLAQRVLLKDDLYKIRAQVAHWIAEDVVQVVLITGGTGFTGRDSTPEAVACLLDKQVDGFGELFRQISVPDIGTSSVQSRALAGLANGTLVCCLPGSTNAVRTGWDGILAEQLDSRHRPCNFVTHLKQAAPCESRG

SEQ ID NO: 8734 - protein, 290 aa, Triticum aestivum
HEDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 8735 - protein, 380 aa, Desulfovibrio vulgaris subsp. vulgaris (strain Hildenborough)
MRKTVYWIEGDGIGPEVWKAARPVIDAAVEKSYGDSRSIEWKELLAGEKAHRETGEYLPQSTLDTLATAELAIKGPLGTPVGKGFRSLNVTMRQTLDLYACIRPIRYFDGIMSPVKRPDLVDMVVFRENTEDVYAGIEYRAGTPEAKRLIAFLRDELGAKVDIEAAVGIKPMTEKGSKRLVRRALRFAIDQKRPNLTLVHKGNIMKFTEGGFREWGYEVARDEFADLTTTETEGTAGRLVVKDRIADAMFQEVLIRPQQYSVIATSNLNGDYISDALAAQVGGLGLAPGVNMSDSLAFFEATHGTAPTIAGQDKANPGSLILCGALMLEHMGWNEAAERIYKAVNEAIASRRVTVDLATQMENATTVGTVAFGDIVTAGL

SEQ ID NO: 8736 - protein, 397 aa, Streptomyces coelicolor
MLGIVLAGGEGKRLMPLTAARAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSLVITPGSDGQTVTGFLEKPPNPPGLGHDPGCVFPSMGNYVFTTKALVEALHRDAEDPDSVHDMGGSILPQLTDRGEAALYDFSANHVPGETTRDQGYWRDVGTLDAYYDAYMDLIAERPAFNLYNRDWPVYTHSTQLSPARFNAGGIASESIISAGCLIRGQVTRSVLSPGVVVDPGAVVQGSVLHNVHIGRGAVVRGAVLDKNVQVPPGATIGVNPQRDGELYTVSKGGVIALGKGQRVP

SEQ ID NO: 8737 - protein, 198 aa, Streptococcus pneumoniae
GIEDILVVTGKSKRSIEDHFDSNFELEYNLKEKGKIDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 8738 - protein, 342 aa, Azotobacter vinelandii
MAQTMKAAVVVEFGKPLEIREVPVPTPGPGQLLVKIAACGVCHTDLHAAEGDWPVKPEPPFIPGHEGVGQVVAVGAGVGHVKEGDRVGIPWLHSSCGHCEHCLGGWETLCLAQSNTGYSVNGGFAEYALADAEYVGHLPDNADFIEIAPILCAGVTVYKGLKMTDTRPGQWVAISGIGGLGHMAVQYARAMGLNVAAVDVDDAKLELARRLGASLTVNARDQDPTAFLHKEIGGMHGVLVTAVSPKAFEQALGMARRGGTVALNGLPPGEFSLSIFDMVLNGTTVRGSIVGTRLDLQEALDFAGQGKVRATVASEPLENINDIFARMHKGQIEGRIVLDLAA

SEQ ID NO: 8739 - protein, 199 aa, Glycine max
  unsure (1)..(199): unsure at all Xaa locations
MSITTTQALTPLSSSRKSRSRTTFGANSTSTSFPATPLSSNLLLFKLSHTSSKRTSTTFHAFKRFSPVMEWQDCTVKMEIDVPISVAYTCYSDREAIPNWMPFISSVKILPDKPDLSRWSLKYKAFGRDIEFSWLARNMQPIPNQKIHWRSMEGLQNXLTVSYEVPQLLAPVASALQPFLEGLLTRGLERFAKFAKSYT

SEQ ID NO: 8740 - protein, 375 aa, Arabidopsis thaliana
MPLSLQPPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLASSMGPASV

SEQ ID NO: 8741 - protein, 328 aa, Arabidopsis thaliana
MVVADVDSGESEDSEVRTSSGMFLTKRQDDIVANVEAKLAAWTFLPEENGEALQILHYENGQKYDPHFDYFYDKKALELGGHRIATVLMYLSNVTKGGETVFPNWKGKTPQLKDDSWSKCAKQGYAVKPRKGDALLFFNLHLNGTTDPNSLHGSCPVIEGEKWSATRWIHVRSFGKKKLVCVDDHESCQEWADAGECEKNPMYMVGVGKKTGTDYPNRKRPEKLDQKPNSNSKIYPIGSKIPLPKKPKPNPKIPGYFIRKSKFYLKPEILPENLGIYPKNLDIHPKIWYRFQKRAQNSIFEPTGTRLDPNRHRTDILDLPYWILNFST

SEQ ID NO: 8742 - protein, 172 aa, Xanthomonas axonopodis pv. citri str. 306
MRPGHLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPFFVGGAWQPLAGDAARSAWLRHQVLHQRRQLGSGRQQLPHVLHSRCDQVPRHGACVQAGSAHQSG

SEQ ID NO: 8743 - protein, 161 aa, Oryza sativa
MGSEGSAGVVVVPRNFRLLEELERGEKGIGDGTVSYGMDDADDIYMRSWTGTIIGPPNTVHEGRIYQLKLFCDTDYPDRPPTVRFQTRINMSCVNQETGMVEPSLFPMLGNWQREHTMQDILIGLKKEMSAPQNRRLHQPHDGNEDQRVEQKGLSLRCVIM

SEQ ID NO: 8744 - protein, 590 aa, Glycine max
MAHFEKDEVPMLSETHARLSDEVVDSNFRRLVSRTRSASISIPMASLESYEKETSLVGHTGPLCSVRKTPFVQMSGPLYATNGTGNLSRQNIVATRTKVVESKTEKFSTFNGTDENRWDNDYNRKNEHLMRSGQLGMCNDPYCTTCPTYFKASQPRTRRTSAIFDPQLRMAYVSPESRVQSAGDLADHPSKIALSYLKGYFFIDLFVVLPLPQIMILFVLPKYLGLSGANYAKNLLRAAILVQYFPRLFRFLPLLIGQSPTGFIFESAWANFIINLLIFMLSGHVVGSGWYLFGLQRVNQCLRNACRDSNITGCSAFIDCGYGADDVSGRAEVWNNNVNATACLNSSSDAFKYGIYVNAVPLTIETRVVHKYVFALFWGFQQISTLAGNQTPSYFVWEVLFTMAIIGLGLLLFALLIGNIQNFLQALGRRRLEMQLRGRDVEQWMSHRRLPEDLRRRVRHAERYSWAATRGVNEEILLENMQEDLQTDIRRHLFKFVKKVRIFALMDEPILDAICERLKQKTYIKGSKVLSQGSLVEKMVFVVRGTLESFGDDGTMVPLSEGDACGEELLTWYLEHSSVSTDGKKVRVQG

SEQ ID NO: 8745 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEGSSDVNDQNVNETSRKRSSDGGPGAETTTGGNTECVLAPNHTLGNATIFAQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVS

SEQ ID NO: 8746 - protein, 422 aa, Staphylococcus epidermidis ATCC 12228
MSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYAGLNKVNPSSEILSSVLMLEHLGWQEAADKITDSIEATIASKIVTYDFARLMDGAKEVSTSDFADELIKNIR

SEQ ID NO: 8747 - protein, 691 aa, Zea mays
MLQECLKLTPFAMLSNSARGKIERKRGDQRGREMLQVEEALAAVLSAAAGHAEPHAVPLQGALGLVLAEDVCAPDPLPPFRASIKDGYAVVASDGPGEYPVVTESRAGDDALGVVVVPGTVAYVTTGGPVPDGADAVVQVEDTEQLPGGADGSKRVRILARASQGQDIRSVGCDIEKDSIVLKSGEHIGPAEIGLLATVGVTTVKVYPRPTIAVFSTGDELVQPATATLSRGQIRDSNRAMLLACAVQQKCKVVDLGIAEDTEESLKEHMDAALRSNADIIITSGGVSMGDRDLVKPCLAKMGKIHFEKIQMKPGKPLTFAEITTQDTPKPSKTVLAFGLPGNPVSCIVCFNLFVVPAIRLLSGWSNPHLQRVHVRISHPLRADPHRTEFHRAAIRWVLDDGSGRPGFVAESTGHQASSRLLSMKSANALLEIPSTGQILAAGTSIQAIIISDIITSSDKLPTPSNPYPSCGPSAKSISADVSQIASPQDAEVKVAILTVSDTVSSGAGPDRSGPRAVSVVNSSSEKLGGATVVATAVVPDEVDKIKGILVQWSDIDHVNLILTLGGTGFTPRDVTPEATKMVIQKEAPGLTFVMLQESLKITPFAMLSRATAGIRGSTLIINMPGNPNAVAECLEALLPALKHALKQIKGDKREKHPRHTPHAAAVPVDQWERSFRAASSGNGGGCSCDP

SEQ ID NO: 8748 - protein, 572 aa, GIBBERELLA ZEAE PH-1
MVGLGPRRPPSRKAVACSRYCHGGAEPAKMSCNDDVGSINPDRGVRRQKQDEALHDFTEITILGKPAVQDREPMSLTFRACPNAGFYYGGSQRGSMADVPKDLAEEINKLENLFTVQPSKLKEITNHFVSELAKGLSVEGGSIPMNPTWVMSYPDGYETGTYLALDMGGTNLRVCQITLTDEKSEFDIIQSKYRMPEELKSGTSEELWEYIAECLYQFLETHHGDCTKLEKIPLGFTFSYPATQNYIDEGILQRWTKGFDIDGVEGQNIVPMFEEALKTRGVPIKLAAIINDTTGTLIASAYTDTAMKIGCIFGTGCNAAYMEDCGSIPKIADLNLPADLPMAINCEWGAFDNEHKVLPRTPYDVIIDKESPRPGQQAFEKMIAGLYLGEIFRLILVDLHDNKSIHIFENQDIALLRKPYSLDASFLSAIEEDPWENLSETSDLFSKKLNLKCTQPELELIRRTAELIGTRAARLSACGVAAICKKKNYQSCHVGADGSVFNKYPHFKERGAKALRDILDWPEKTNKKEEDPIEVLTAEDGSGVGAALIAALTLKRINEGNMAGILHPENFK

SEQ ID NO: 8749 - protein, 1212 aa, Oryza sativa
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGKRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 8750 - protein, 420 aa, Oryza sativa (japonica cultivar-group)
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 8751 - protein, 209 aa, Nostoc punctiforme
MLRVPSNLDLAGAAPLLCAGITTYSPMRHWGVTEGKKVGLVGLGGLGHMGVKFAHAFGAHVVVFTTSPDKKEDALRLGADEVVVSRNADEMQKHAGSFDFILDTVSAKHDINAYLNLLRLDGNITLVGAPEKPLDVAAFSLIMARRSLSGSNIGGIPETQEMLDFCGKHNITADVEVIPIQKVNEAYDRLLKSDVKYRFVIDMASLKSE

SEQ ID NO: 8752 - protein, 346 aa, Vibrio vulnificus CMCP6
MLKVAINGFGRIGRNVLRAVYESGKHQQIKVVAVNELAQPEAMAHLLQYDTSHGRFGKRISHDQEHLYVHHDACPQGKGEFDSIRILHLSEINLLPWRDLEVDLVLDCTGVFGCQADGLEHIKAGAKKVLFSHPGASDLDNTIIYGVNHETLKAEHNVVSNGSCTTNCIVPIIKVLDEAFGIESGTITTIHSSMNDQQVIDAYHSDLRRTRAASQSIIPVDTKLHKGIERIFPKFSNKFEAISVRVPTVNVTAMDLSVTINTNVKVNDVNQTIVNASQCTLRGIVDYTEAPLVSIDFNHDPHSAIVDGSQTRVSNGHLVKMLVWCDNEWGFANRMLDTALAMQAAQ

SEQ ID NO: 8753 - protein, 455 aa, Sarcothalia ancistroclada
VVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTSATMEEMYERAEFAKQLGSIIIMVDLVIGYPAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGATANRVALESMVIARNEGRDYVTEGPQILQDAAKTCGPLQTALDLWKDISFNYTSTDTADFVETPTANV

SEQ ID NO: 8754 - protein, 896 aa, Pseudomonas syringae pv. syringae B728a
MIKQGLGLSLLALGIAQAGSVFAVTPMTGNEVEARVGAMLDNMTQSEKINFSRVDDGRMIPKLDKFNLQGTVAYDSAMGVLVGGKTFGAQYPSPSALAATWSINRAKEFGLAIGYETRIAGGQQMLSPAINLYRTPFNGRAAEYMSGEDPFLGAVLAPAVTNGIQVQGVQAAAKHYLMNEQEANRHYLDVKIDERAMQELYLPGFESLVKNSNIASIMCGYNKINGEYACENHHLITDILKGQWGFQGNVMSDFNSVQDAFKGAWAGTDIDMPSGLQFTEAKLLPYVWNGQLHQNVIDDKVRRNLRALVSYGFDKGINKAQPLEHREYGQLAALNVARESIVLLRNEPVDGQKPVLPLSRNARIAVIGDMAMQPPTAPFGTAYSAPASYVTEVSGLKQLASDPSNVDYLPQMSLNPKSSVWYQPGSDQQAISNTGVKAEYYANTSLSGDPVATRVEPGVNLDWITNTNVTDYGSSAVNGYSPSAGSFSARFTGKIKPTITGPQVFKVRADGAYKLWINDELVLEDEGAQVSFDLIPVVPRTVKTPNLKAGSEYNVRLEYRRLKGNFTPVLGGMNGVQMSWAALRPPKNLGDYDAVVVAAGNNFEYEGESLDRPFELPQFQSELIGFIQKANPKTIVVLHGGGGMDMQPWADKVAASLHAWYPGQQGGQALAEILFGKVNPSGKLPITLDKKAQDNPSYASYSNPVPYYFSSPNPPVEMSYSEGLYLGYRGYDKKHTKPLYPFGFGLSYTTYAYSDLKLSSNVLAPGATIQASFKVTNTGDKAGFEVAQLYVQPSKPLVDRPEKELKGFSKVYLKPGESKTVTIALDSRSFAYYSANSVSWNVDPGKFKVLVGKDSENLTLDRTVVALYPEQLTTRDSNPLPIPLRKAVQVKAEQAY

SEQ ID NO: 8755 - protein, 356 aa, Desulfovibrio desulfuricans G20
MHTKLRTVMKAANDVRRCRGRADTLCWGQTAPVRPRGGSNTPRVQHQRSIHMQIAIIGLGRMGMNMARRLLRGGHEVAVWNRSPAKTQVMEAEGAAGFTSLQALAASLAPPRTLWFMLPAGEATQQRMDEVLPFLQPGDVVVDGANAYWKDDRPRADRLAAHGIRYVDAGVSGGIWGLENGYCTMLGGEAADIRHLAPVLDTLAPPQGWMHCGPAGAGHFVKMVHNGIEYAMMESYGEGFDLLRNGPFSGLDLQGIAALWNRGSVVRSWLLELLDAALKKDPGLASLKGYVDDSGEGRWTVTDAVDHAVPVPVLAQALFRRFESRQDDLFSNKVLAALRNEFGGHAVKNTDEGDAS

SEQ ID NO: 8756 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNAL

SEQ ID NO: 8757 - protein, 76 aa, Zea mays
CLYVALQMSVQDANMSSDTDMSKVFEDRTFVSSILNSLPGVDPNDPSVKDLLASLHSQGEQEKKEDTSDKTEDDKN

SEQ ID NO: 8758 - protein, 665 aa, GIBBERELLA ZEAE PH-1
MTLLQRSRLAASGLSRCRPGQLQSSVRRYQSVAATSVISQRDGRNTSLSLSATPKASTAIHNVSPTAVMARPYSTASEDMYTASFAFFEAIWDAGITHCFVNLGTDHPSIIEAMVKGQREKKGKFPKIITCPNEMVAMSMADGYARLTGKPQCVIVHVDVGTQGLGAAVHNASTGRAPVLVFAGLSPFTQEGEHRGSRTEYIHWIQDVPDQKQIVSQYCRYTGEIKTGANVKQMVNRALQFATSDPQGPVYLCSAREILEADLKPYSLKQEHWEPVELGGLPTSAVDKIANALAGAKAPLLVTGYSGRNHKVPAALVELADKVKGLRVLDTGGCDMCFPADHPAWVGLAFGVHEAVTTADTIIVLDCDVPWVQTRCKPREDAKIFHIDVDPLKQQMPTHYIQADARYKADALASVEQITRALDKKEFSSKLQSNEAKAAEKERAEIHETKLATIAKGAEPLADGSFGTGHLSKKLKDLCPEDTIWAIEAVTNTGFVHDNVQPTIPGSWINCGGGGLGWSGGGALGIKLATDAENGGTNKGKFVVQIVGDGTYLFTVPGSVYWISRRYKIPVLTIVLNNKGWNAPRRSLLLVHPDGLGSKATNEEINISFDPVPDYAGIAKAAAGGDIHAARVDKASDLESVLKEAIAKVQAGQTAVVDCKVAPDC

SEQ ID NO: 8759 - protein, 324 aa, Stellaria longipes
MENFPIINMENIERKNTRDMIKDACENWGFFECVNHGIPHSLLDKMEKMEKLTKDHVRECLEERFKEMVASKGLEGVESEVTDLDWESIFFLKHLPVSSISELPDLDEEYREVMIDFSKRKEKKAETKKDKKCENKGKEKSYLKNTFYGSKRPNFGTSVSNYPPLPKPDLIKGLSAHTDAGGIKLLSEDDKVSGLELLKDSDWIDVPPMRHSIVVNLGDELEVITNGKYWSVMHRVQIDTNITRMSTASFYVPGNDRVIAPAEALPKEFKDDEVYPKFVFKSYMKAYAKLIRQSGLKFEAKEPRFEAMKAHRIGSSCNSHLEHD

SEQ ID NO: 8760 - protein, 470 aa, Lactobacillus casei
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 8761 - protein, 563 aa, Desulfovibrio vulgaris subsp. vulgaris (strain Hildenborough)
MQLNGAQILLECLKKEGVDVFFGYPGGAVIDIYDEIPRHPELHHVLVRHEQAAVHAADGYARASGKVGVCLVTSGPGATNTVTGIATAYSDSIPVVILTGQVPTPLIGNDAFQEVDIVGITRPCTKHNYLVRDVKELATVVRQAFYLARTGRPGPVLVDLPKDVMQAKTDFVWPEDVSMRSYNPTYKPNLNQIRRAADAFFEAERPLLFVGGGVVMSDASEELGWFARTLRIPVASTLMGLGAFPGDDPLWLGMLGMHGTYAANKAVNNADLIVAVGARFDDRVTGRLSAFASKARIIHIDIDPTSIRKNVQVGIPVVGDCRQSLANIREILVPRLEEKDWGAAHARWLEQLASWRVEQPLGFSREGGIKPQQVIEQLFAITRGDAIITTEVGQNQMWTAQFYTFRKPRTLITSGGLGTMGYGFPAAIGAQFAFPDKLVVDVAGDGSIQMNIQELATAVCNKLPVKILILNNGYLGMVRQWQELFYQRNYCSTCMDAQPDFVKLAEAYGAEGYRITEVESLESTLREALASPHPAIIDVRVEREENVYPMVPAGAALDEMLLV

SEQ ID NO: 8762 - protein, 302 aa, Yarrowia lipolytica
MSDFLVDFMMGGISAAVSKTAAAPIERVKLLIQNQEEMIKQGRLSRPYAGIIDCFKRTAAEEGVVSFWRGNTANVIRYFPTQALNFAFKDKFKKMFGFKKSEGYWMWMMGNLASGGLAGATSLAFVYSLDFARTRLANDAKSVAKDGKAAGERQFNGLIDVYRKTIASDGIAGLYRGFGVSVVGIIVYRGLYFGLYDSLKPVVLVGPLEGNFLAAFLLGWTVTTGASTASYPLDTIRRRMMMTSGTGVKYSSAFDCGVQIVKAEGVASLFRGCGANILRGVAGAGVISMYDQMQMILFGKKF

SEQ ID NO: 8763 - protein, 138 aa, Triticum aestivum
MTSAKTLARLAKKWQRVAAMGRKRLTWSPSTSKEEAGESCSTPCSTAAGKGHCVVYTADGVRFEVPLTFLGTTIFSELLRISQEEFGFTGVDGGRITLPCDASVMEYAMCLLRRSASTEMEAAFLNTMVMPCHYHVAH

SEQ ID NO: 8764 - protein, 451 aa, Synechococcus sp. PCC 7942
MPSNTAAMLHVVQAIATTGANLTEMELLQRTNQWIDRRLIVEAASEEQAAAVVEAIAAVPDLELLDSEDRTFALHRGGKISVEPKLPLTSQAQLAMAYTPGVGRVCKAIAANPDRVYELTVKQNMVAIVTDGTAVLGLGNLGPAGALPVMEGKAMLFKAFGDVDAFPICLDTQDTDEIVETMKRIAPVFGGVNLEDIAAPRCFEIEARLKQELDIPVFHDDQHGTAIVTLAALENALKLVKKSLSQVRIVMNGAGAAGLSVASLLREAGATNIIICDSRGILSCDRSDLTPQKQAFAIEAGGSLADALVNADVFIGVSVPGVLTVEMVETMASDRIIFAMANPIPEIQPELIQGRAAVIATGRSDYPNQINNVLAFPGVFRGALDCRAKSLTSSMFLAAARAIAALVPPETLSAEHIVPSAFDSRVAPAVAAAVVEAAQANGLAQTLAVTH

SEQ ID NO: 8765 - protein, 568 aa, Triticum turgidum
MASWFETYHHPSKPPRERETAAFFGCRLGIRENNCELTCASCRSFLPPVKILIRSIRLGCCCSWVRGSCACCCSWIRGLCGRKKREAGKETSTPETKKTKRKWRRNFCGWTSHEAEEPLTSETKKKREAGQEASTSETKKTKRKWGRSFCGWTSHEAEEPLTSETKKKRKNGASSSEPDKKRWFKNKIWRKKKAKNKQLATLVKEISLPNSPKARAAAGEILRIGNHNIPSRVFAYSQLSDATNSFSQENLLGEGGFGRVYKGYISETMEVIAVKQLDKDGLQGNREFLVEVLMLSLLHHPHLVTLLGYCTECDQKILVYEYMPLGSLQDHLLDLTPKSQPLSWNTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPKLDSKYPLKGLYQALAISSMCLQEEASSRPLISDVVTALTFLADPNYDPPDDIEPLPITVPDFDRGISLSEPEEVKEKFEGKQVEDS

SEQ ID NO: 8766 - protein, 372 aa, Yersinia pestis KIM
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 8767 - protein, 1065 aa, Arabidopsis thaliana
MDPSSINSSRRKRIGGAVVAAGSVWETRMQSDDEVCNNAIVLHVTNEDKTSSTKQMTLKDETLLGVNGKRRTWKSRASDVKNPSTLEIVRANSLKVTKPRSIGTPPMTPRRSLSSSDSNDKSPSVSVVAKKARSESVEGIEKKTTPGRVKKIRSEVCTTIVKAGEFDSVALRKVNSLPSPNSEKSDTKTEQEVTIIENSKIPEEVKEFGVCQEMIVSAKSNENEQIDNGDQEIGDQDDYEEDGDEEEEREVEKKSVDVKEINVAKENRVGGVEIKKFSQFQNRTSPSPSSVRKISPPCFVSSTAICLLNSDESSVFHDCFQIDLQSKKTTLLIHRVNCRVWMWRDVSRSTLVFGFGTFLIISSSYANDLNFSMELKCDENVQLHIGGSVHGTHLSRSHVRIKITDPQACNNGRRGMVEEERHKVVGVREEDVKRMLRLIMPYLNESLHQLRALFSGDPSTTLKMGVVLFVLARCGSSITLWNLAKFGNFWMRRFRDAWESCNHKKAVALALFTLVWNLSSVTARVWAAFMLLVAFRYYQHKMIWTTDQADDDEDDNEEEEAEEEKEQRALLHKLFSFREITNRTEVESFTSSLLRLLTVVTSPLFSFQNPKSRFDFLSPPTNKFKMSVASDSPVHSSSSSDDLAAFLDAELDSASDASSGPSEEEEAEDDVESGLKRQKLEHLEEASSSKGECEHPGSFGNMCFVCGQKLEETGVSFRYIHKEMRLNEDEISRLRDSDSRFLQRQRKLYLVLDLDHTLLNTTILRDLKPEEEYLKSHTHSLQDGCNVSGGSLFLLEFMQMMTKLRPFVHSFLKEASEMFVMYIYTMGDRNYARQMAKLLDPKGEYFGDRVISRDDGTVRHEKSLDVVLGQESAVLILDDTENAWPKHKDNLIVIERYHFFSSSCRQFDHRYKSLSELKSDESEPDGALATVLKVLKQAHALFFENVDEGISNRDVRLMLKQVRKEILKGCKIVFSRVFPTKAKPEDHPLWKMAEELGATCATEVDASVTHVVAMDVGTEKARWAVREKKYVVHRGWIDAANYLWMKQPEENFGLEQLKKQLTEEE

SEQ ID NO: 8768 - protein, 71 aa, Salmonella enterica
EQALYYIGGVIKHAKAINALANPTTNSYKRLVPGYEAPVMLAYSARNRSASIRIPVVASPKARRIEVRFPD

SEQ ID NO: 8769 - protein, 396 aa, Linum usitatissimum
MALKLNPVTTFPSTRSLNNFSSRSPRTFLMAASTFNSTSTKEAEKLKKSHGPPKEVHMQVTHSMPPQKLEIFKSLEGWAEDVLLPHLKPVEKCWQPQDFLPEPESDGFEEQVKELRARAKELPDDYFVVLVGDMITEEALPTYQTMLNTLDGVRDETGASLTPWAIWTRAWTAEENRHGDLLNKYLYLSGRVDMRQIEKTIQYLIGSGMDPKTENNPYLGFIYTPFQERATFISHGNTARLAKDHGDMKLAQICGIIAADEKRHETAYTKIVEKLFEIDPDGTVLALADMMRKKISMPAHLMYDGEDDNLFDNYSSVAQRIGVYTAKDYADILEFLVGRWKVDAFTGLSGEGNKAQEFVCGLPARIRKLEERAAGRAKQTSKSVPFSWIFSRELVL

SEQ ID NO: 8770 - protein, 423 aa, Saccharomyces cerevisiae
MILLLILFPCIYFLPFCINRTVRSSPEYSAADYYKSSIQYHKSYSNMPHSVTPSIEQDSLKIAILGAAGGIGQSLSLLLKAQLQYQLKESNRSVTHIHLALYDVNQEAINGVTADLSHIDTPISVSSHSPAGGIENCLHNASIVVIPAGVPRKPGMTRDDLFNVNAGIISQLGDSIAECCDLSKVFVLVISNPVNSLVPVMVSNILKNHPQSRNSGIERRIMGVTKLDIVRASTFLREINIESGLTPRVNSMPDVPVIGGHSGETIIPLFSQSNFLSRLNEDQLKYLIHRVQYGGDEVVKAKNGKGSATLSMAHAGYKCVVQFVSLLLGNIEQIHGTYYVPLKDANNFPIAPGADQLLPLVDGADYFAIPLTITTKGVSYVDYDIVNRMNDMERNQMLPICVSQLKKNIDKGLEFVASRSASS

SEQ ID NO: 8771 - protein, 175 aa, Oryza sativa (japonica cultivar-group); identical to SEQ ID NO: 1798

SEQ ID NO: 8772 - protein, 492 aa, Oryza sativa
MDPYKGRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFLSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGSSCRGSTTPTTSCCRRGSSPTPTRSATGWDQNYLVVPANAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 8773 - protein, 768 aa, Emericella nidulans
MADTALVDHSPHHPTKAPRLETASNVILIDNYDSFTWNVYQYLVLEGATVTVIRNDEISLEELIAKKPTQLVVSPGPGHPKSDAGISNAAIQYFAGKIPIFGVCMGQQCIHHSFGGKVDVTGEILHGKTSVLKHDGRGAYEGLPPSVIITRYHSLAGTHSTIPECLEVSSFAQLGEDADKTVIMGVRHKQFAVEGVQFHPESILTEHGQTMFRNFLKLTAGTWEGNGKDVAQGGNFTAAAPNPPKATKQVSILEKIYDHRRAAVAKQKTIPSQRPSDLQAAYELSVAPPQISFPDRLRQSAYPLSLMAEIKRASPSKGLIAEHACAPAQARQYAKAGASVISVLTEPEWFKGSIDDLRAVRASLEGLTNRPAILRKEFIFDEYQILEARLAGADTVLLIVKMLDTELLTRLYLYSQSLGMEPLVEVNTPDEMKIAVDLGAQVIGVNNRDLTSFEVDLGTTSRLMDQVPESTIVCALSGISGPKDVEAYKKDGVKAILVGEALMRAPDTAAFVAELLGGQSKKLPLQSRNSPLVKICGTRTEEGARAAIEAGADLIGIILVEGRKRTVPDDVALQISKVVKSTPRPTPYPTEVPQGDTDATSVDYFDHSATTLRHPTRALLVGVFLNQPLSYVLAQQQKLGLDVVQLHGSEPLEWSRLIPVPVIRKFGLDEFGIARRAYHTVPLLDSGAGGSGELLDQMRVKQILKSDDGLRVILAGGLDPLNVTEIIKQLDESGYKIVGVDVSSGVETNGVQDLDKIRSFVQAAKSAF

SEQ ID NO: 8774 - protein, 448 aa, Streptococcus pyogenes M1 GAS
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDEADKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 8775 - protein, 321 aa, Shewanella sp. SK-3-30-1
CIGCHTCSITCKNVWTSREGVEYAWFNNVETKPGIGFPKEWENQNKWNGGWKRTDAGKLELKIGGKIRLLAKIFANPDLPEIDDYYEPFDFDYEYLHTAPDSQHQPVARPRSLITGQRMEKIEWGPNWEEILGTEFEKRKKDNNFDNVIQKDIYGQFEKTFMMYLPRLCEHCLNPACVASCPSGSIYKREEDGIVLIDQDKCRGWRMCVSACPYKKIYFNWKSGKSEKCTFCFPRIEAGQPTVCSETCVGRIRYLGVLLYDADQIEIAANTPNEKDLYQAQLDVFLDPNDPAVIEAARKEGISDNWITAAQRSPVYKMAID

SEQ ID NO: 8776 - protein, 512 aa, Shigella flexneri 2a str. 301
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPILRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 8777 - protein, 201 aa, Yersinia bercovieri
GSSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFGK

SEQ ID NO: 8778 - protein, 134 aa, Triticum aestivum
  unsure (1)..(134): unsure at all Xaa locations
MDPCKFRPSSSFDTKTTTTNAGQPVWNDNEALTVXGPRGPILLEDYHLLEKIAHFRAPKRIPERVVHARGASXAKGFFEXTHDVTGLTCADFLRRAXGARTPVIVRFSTVXHERGSPETIRDPRGFAVKFYTRE

SEQ ID NO: 8779 - protein, 390 aa, Helicobacter pylori J99
MISFKEALKIHSNIPLKPLEVEVVSLFESAGRILAEDIICVHALPKFNQSAMDGYGFKMQDLGQKTQVIQHIFAGDDVSALEVKENECVKIMTGAMVPKGIETIVPIECMLESHKDFALAPKDFKIHANIRQKGENASLNSVLVPKNTRLNYGHIALIASQGFKEIKAFRKLKIALFSSGDELVPLGQNALECQVYDVNSVGVFNMLKNYNTHFLGVLKDDKNLQLKILELQGYDVILSSAGVSVGDKDFFKDALKERNALFYYEKVNLKPGKPVTLAQLNQSIIIGLPGNPLSCLLVLRVLILPLLERLSLNKDFKLKPFKAQINAPLKLNNKRTHLILGNYSNHQFIPYNNRYESGAIQALAQVDSIALIDEGVGLVQGEIEILRFEN

SEQ ID NO: 8780 - protein, 323 aa, Triticum aestivum
MAAKRELVVSFGEMLIDFVPTVAGVSLAEAPAFVKAPGGAPANVAIAVARLGGGAAFVGKLGDDEFGRMLAKILRENGVDAGGVVFDSGARTALAFVTLRADGEREFMFYRNPSADMLLTADELKVDVIKRAAVFHYGSISLIAEPCRTAHLHAMKVAKEAGALLSYDPNLREALWPSLEEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKKGAIPSLPKEDEVLRLMEKA

SEQ ID NO: 8781 - protein, 292 aa, Streptomyces narbonensis
MKGIVLAGGSGTRLHPATSVISKQILPVYNKPMIYYPLSVLMLGGIREIQIISTPQHIELFQSLLGNGRHLGIELDYAVQKEPAGIADALLVGAGHIGDDTCALILGDNIFHGPGLYSLLRDSIARLDGCVLFGYPVKDPERYGVAEVDATGRLTGLVEKPEKPRSHLAVTGLYLYDNDVVDIAKNIRPSPRGELEITDVNRVYLERGRAELVDLGRGFAWLDTGTHDSLLRAAQYVQVLEERQGVWIAGLEEIAFRMGFIDAEACHSLGEGLSRTEYGSYLMEIAGREGAP

SEQ ID NO: 8782 - protein, 478 aa, Suhria vittata
IKNQRYESGVIPYAKMGYWDPDYAVKETDVLALFRVTPQPGVDPVEASAAVAGESSTATWTVVWTDLLTACDLYRAKAYKVELVPNTTDQYFAFVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEANLPQGIFFEQDWASLRKVTPVASGGIHCGQMHQLLDYLGDDVVLQFGGGTIGHPDGIQAGATANRVALEAVVIARNEGRDYVEEGPQILRDAAKTCGPLQTALDLWKDISFNYTSTDTADFVETPTANV

SEQ ID NO: 8783 - protein, 94 aa, Zea mays
  unsure (1)..(94): unsure at all Xaa locations
VVHAALSDKSYTAVASLCDELLLQAASKGTNTDEWPYSVHLLAHLYINDLNSARXFWKSLPQEVKDTRPELAAVWRIESYRQRIFKLLTSAYST

SEQ ID NO: 8784 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 8785 - protein, 427 aa, Batrachospermum atrum
IEASAAIAGESSTATWTVVWTDLLTACDLYRAKAYKVDAVPNTSDQYFAYIAYDIDLFEEASIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSIEGVNRAQAAAGEIKGHYLNVTAATMEDMYERAEFAKELGSIICMIDLVIGYTAIQSMAIWARKADMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 8786 - protein, 225 aa, Amaranthus tricolor
KWHVIMACRDFLKAERAAKSAGMAKENYTIMHLDLASLDSVRQFVNNFRQSGRPLDVLVCNAAVYLPTAREPTYTAEGFELSVGTNHLGHFLLSRLLLEDLKKSDYPSTRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRFLFPPFQKYITKG

SEQ ID NO: 8787 - protein, 595 aa, Oryza sativa
MAPWSGLWGGKLAAGESPVLRSRFYAFIRAFVVLSVLLLIVELGAYINGWDDLAASALALPVIGVESLYASWLRFRATYVAPFIQFLTDACVVLFLIQSADRLIQCLGCFYIHLKRIKPNPKSPALPHPEDPDAAYYPMVLVQIPMCNEKEVYQQSIAAVCNLDWPRSNFLVQVLDDSDDPTTQTLIREEVLKWQQNGARIVYRHRVLRDGYKAGNLKSAMSCSYVKDYEFVAIFDADFQPNPDFLKRTVPHFKDNDELGLVQARWSFVNKDENLLTRLQNINLCFHFEVEQQVNGIFLNFFGFNGTAGVWRIKALDDSGGWMERTTVEDMDIAVRAHLRGWKFIFLNDVECQCELPESYEAYRKQQHRWHSGPMQLFRLCLPDIIKCKIVFWKKANLIFLFFLLRKLILPFYSFTLFCIILPMTMFVPEAELPDWVVCYIPALMSLLNILPSPKSFPFIIPYLLFENTMSVTKFNAMISGLFQLGNAYEWVVTKKSGRSSEGDLISLAPKELKHQKTESAPNLDAIAKEQSAPRKDVKKKHNRIYKKELALSLLLLTAAARSLLSKQGIHFYFLLFQGISFLLVGLDLIGEQIE

SEQ ID NO: 8788 - protein, 183 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVIIGSGGEPSFHLVGFIMCIGATAAR

SEQ ID NO: 8789 - protein, 506 aa, ASPERGILLUS NIDULANS FGSC A4
MSATKAESQKIFEKLKTKPANKTDPVFAEITQICFDCGSKNPTWSSVPFGIYLCLDCSANHRNLGVHISFVRSTNLDQWQWEQLRIMKVGGNESATKYFQSNGGSAALASKDVKVKYTSNAAVKYKEELKRRAALDAQEYPEEVVITDVPAGATSNGSSTPAGDDDDFFSSWDKPSIKRPSNPPSRTGTPPVVSRTSSPFLNAGANTARSKSPLSSDKESATASPAPTAIRASAAARKTSGTTTAKKGSVLGTKKAPKLGAKKIGGADLIDFEEAERKAKEEAERIEKLGYDPEAEEAEAAKTKTSGTGATAIASPTPLSPNKVGFGATKTTHERNSSDVERLGMGIGRLGFGQTVGSKPTAPAPKKLGFGAVGAARSAEDEEELQRTKNKFGAQKGISSDEFFGRDRFDPVAQSEAKERLRQFDGAQAISSNSYFGRPEDDYPPVDDTYGDLEAAAKDFVRRFGITAGDDLENLTQLVGDGASKLQAKRVQEFLFHNDILSLRTR

SEQ ID NO: 8790 - protein, 145 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 8791 - protein, 504 aa, Zea mays
MVVRISGQTHRGQNTRPQSSADAARSMIGFRYLGSCCHTVIKRETKQHFSWRLLNIYGFCKRRCKNMRQHFQNGTKKMQRCFHGQICIFDHSGKMHRVKAKSEKYFDSNCLCGKLLKTLFVCVGKKKKRTNVKGGLCCGAGHQQQWALPFAGSLQVSPPPQQAQPDRKGRGGGGVMDSGSRSSGGAGFDDEDGLTTRREVSSSLQDLAVRVDWKGGSCSDGGTNQGPNTPRSKHSATEQRRRSKINDRFQILRELLPHNDQKRDKATFLLEVIEYIRFLQEKAQKYEATFPEWNQENPTMLPWSKGQIPGDSPPDPSHFVRNGSSPGSNFTGKLDDNHTSAAASGALDQAETNHVASGCYRSSETPANITNNAISQSQPQWTGPSPVDDSAVKSEMLNSQELAIDEGMISVSSTYSQELLISLSHALQSSGVDLSQTSISVQINLGKRAGKRSASAGGVSSNSKEPPADPASSNELGGHHVTTLGASADGLLPHATKRHKRDNS

SEQ ID NO: 8792 - protein, 203 aa, Ananas comosus
ACENWGFFEILNHGITREMMDEVERLTKDHYRRSREQRFEEFANKALEDGTNGVDVSSNLDWESTFFVRHLPVSNISELSDLNDHYRNVMKEFAVELEKLAERLLDLLCENLGLEKGYLKKAFCGSNGPTFGTKVSSYPPCPRPDLIKGLRAHTDAGGIILLFQDDRVSGLQLLKDGEWVDVPPTPYSIVVNLGDQLEVITNG

SEQ ID NO: 8793 - protein, 448 aa, Gelidium crinale
VNPYAKMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKD

SEQ ID NO: 8794 - protein, 354 aa, Schizophyllum commune
MGCVQSSGVDEEAKARNDEIESQLKKDRMMAKNEIKMLLLGAGESGKSTVLKQMKLIHHGGYNEQERDSYKEIIFSNTIQSMRAILEAMPQLDIPLTPQNDARRAVIMSMPMQIEADVLPPDVVDAIRSLWKDPGVRQAVQRSREFQLNDSAVYYFNSIDRMAAPNYMPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGDNYDAACDYLLHRFVSLNQSAATKQIYAHYTCATDTQQIKFVLSAIQDILLQLHLRECGLL

SEQ ID NO: 8795 - protein, 225 aa, Wolbachia endosymbiont of Drosophila melanogaster
MSIKIAPSILSADFAKLGEEVRKISDLGVDYIHIDVMDGNFVPNITIGPSVVSAIRKYSNLPFDVHLMVKSPGKHIESFINAGADIITVHAEVETHLERLIRKIKSYKNVNDEKKPIQVGVSIVPSTSPSVLEYIIHELDIVLIMTVNPGFGGQEFIHSQLNKISTIKKMIQERNLKTQISVDGGINFFNAADIIKAGADILVAGSAIFKAEDIKKAINYLKNPS

SEQ ID NO: 8796 - protein, 497 aa, Staphylococcus xylosus
MELVKNLSRRQFIDGEWVESSNKETRKIINPFNQEVIFEVAEGTADDSERAILAARRAFEDGEWANETSENRGKKVRAISDLIVKHREELAKLETLDTGKTLEESYADMDDIANVFNFFAGLADKDGGEIIDSPIPNTESKVIKEPIGVVTQITPWNYPLLQASWKIAPALASGCSLVMKPSEITPLTTIRVFELMEEVGFPQGVINLVLGKGSEVGEPLSAHKEVDLVSFTGGIQTGKHIMKNAADHVTNIALELGGKNPNIIFDDADFDLAVDQALNGGFFHAGQVCSAGARIIVHNDIKEKFEAALIERIKNIKLGNGFDEDTEMGPVISAEHREKIENYMEVAKSENATIAIGGKRPEREDLQDGFFFEPTVITDCDTSMRIVQEEVFGPVVTIESFTTEAEAIKLANDSIYGLAGGVFTNDVGKAQRIANKLKMGTVWINDFHPYFAQAPWGGYKQSGIGRELGKAGLAEYQEEKHILRNTNPEPVNWFGKA

SEQ ID NO: 8797 - protein, 166 aa, Triticum aestivum
  unsure (1)..(166): unsure at all Xaa locations
MAQESLRLVCPPVSAHEGRLPRQYTLEGQGAKKDISPPLEWYGVPDGTRSLXAVVVQDVDADERVPWTHWVVVNISPEEKGLPEGFSGAGGNANAGGGDGGVQEGVNDWKQPGWRGPVPDSHGHRIQFRLYALDDVLSLGNKVTVDKVMEAIEGHVLGEAEITAVF

SEQ ID NO: 8798 - protein, 132 aa, Chlorobium tepidum TLS
MLMKIAKDPMRLFDDIWSGSQMAVAPSFKVDISEDENAYHLDAELPGIAKEQIALNIEDDVLTIKAERTHKEEEKKKNYHRVERTYGSFSRSFNIGEIIDQEHIGATYDNGVLHVTLPKTQPAKKTKEIPIN

SEQ ID NO: 8799 - protein, 253 aa, Zea mays
MPSQSTHTSSSLSSSTAPILPCSSAAALFRSVMAAVATETPFHVLAVDDSLPDRKLIERLLKTSSFQGKLSHRMIIPVSFASALMTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTIGSSSDSINNRKRKGAGTEEILPQLANRSRHS

SEQ ID NO: 8800 - protein, 526 aa, Yarrowia lipolytica
MFQLFSILVLAFTTALVAQLAYNQYDYQRKVKKFGCGQLRVAENGLFGWKGLREVLRINKYKLGPAALKDRFEKYGKTHVFHVGPSPLITTMDPENIKAMLATQFKDFCLIARYKALGPMLGDGIFTLDGHGWTHSRALLRPQFAREQVSRLDSIEHHFQILKKCISKEMSDKRDTQRGFDIQNLFFLMTLDTATEFLFGSSVDSLVDFLDDPSIQTGDHGGIDEAARKGFSNAFNRAQELSSLRTRLHKLYWVIGTLAVREPYHRYNREVKTFVDHYAAKAIKARNEKNTDLLDNDKYIFMYELVKETSNPITLRDQMLNILLAGRDTTASMLSWIYFRLARDPKRYAKLRAAVLADFGPGPENITFESLKKCDYLRYVLNESLRVYPVVPINARTASRDTTLPRGGGPDGSQPIFVPKGQTVSYSVWWTHRDPEFWGQDAEEFIPERWDTKNGSIGRGWEYLPFNGGPRICLGQQFALTEVGYVLSRMVQTYETLESGDTKPLPPLYNHALTLCHQEGVWIKTE

SEQ ID NO: 8801 - protein, 396 aa, Ricinus communis
MALKLNPFLSQTQKLPSFALPPMASTRSPKFYMASTLKSGSKEVENLKKPFMPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKL

SEQ ID NO: 8802 - protein, 776 aa, Agrobacterium tumefaciens str. C58
MTVEDMTSHDKNNTPANTAKADIEEQALFFHRYPRPGKLEIQATKPLGNQRDLALAYSPGVAAPCLAIHENPEMAAEYTARANLVAVISNGTAVLGLGNIGPLASKPVMEGKAVLFKKFAGIDVFDIEIDAPGINDMVSTIAALEPTFGGINLEDIKAPECFEVERQLREKMNIPVFHDDQHGTAIIVAAAVTNALELAGKSLSSVKIVASGAGAAALACLNLLVAMGANKENIWVHDIEGLVYEGRNTLMDEWKEVYAQKTDKRVLADSIDGADVFLGLSAAGVLKPELLERMAENPLILALANPNPEIMPEAARAARPDAMICTGRSDFPNQVNNVLCFPYIFRGALDCGATTINEEMKMAAVQAIAELAREEVSEVAARAYSGETPIFGPNYLIPSPFDPRLILRIAPAVARAAAASGVATRPITDFEAYFDQLNRFVWRSGFIMKPVFNAAKAAEKKRIIFAEGEDERVLRAAQVLLEEGTGVPILIGRPQIIETRLKRFGLRIRPHADFAVVNPEDDPRYREYVDDYFALVGRAGINPEAARTIVRTNSTVIGALSVKRGEADALICGLEGRYDRHLRDVNQIIGKQESVRSFAGLSLLITQQGALFLTDTFVNNDPTSEEVAEMAILAAKEIRRFGITPKIALASHSNFGSRDSESARKMRRALKIIQQAAPELEVDGEMQGGSALSEALRKRAMPNSVLTGEANLLVFPNLDAANITLGVTRTLTEGLHVGPILLGTALPAHILSPSVTSRGVVNMAAFAVVQASHPSV

SEQ ID NO: 8803 - protein, 581 aa, Tropheryma whipplei TW08/27
MVRISGAQAVIKSLEELGIDLVFGIPGGAILEVYNSLFSSSIRHILVRHEQGAGHAAEGYACSSGRLGVCLATSGPGATNLVTAIADAYMDSVPILAITGQVYSHLLGSDAFQESDIIGITMPITKHAFSVKRATEIPAAIFAGAKIATTGRPGPVLIDITKDAQQDEFDFMWPPKSIDLSGYSVAQNIPDTLAQFADGFFDMLSGSIRPVIYAGGGTVRSGASEELIRFAEGFGIPVVTTLTARGVLPDSNRLNLGMPGMHGTVAAILALQKSDLLIALGTRFDDRVTGRLDSFAQNARVVHVDIDPAEIGKNRRPDLFVIGDVKEVLGYINSHSENRTTGDLTAWWRSLEKMRQIYPLVFPQKSSDGNLSPGYVIKRLGELSGPDAIYATGVGQHQMWASQAISFSRPNSFLTSGGAGTMGYAVPAAMGAKAANPEKIVWAIDGDGCFQMTNQELATCSVNGLPIKVAVINNRSLGMVRQWQGLFYNKRYSQTDLNTGDAYIPDFCKLAESYSCASCRVSSVDEVDNAIEFALAINDRPVVIDFVVCKDSMVWPMVPQGLGNSHLKYLQDVSPVWHDNE

SEQ ID NO: 8804 - protein, 509 aa, Xanthomonas campestris pv. campestris str. ATCC 33913
MNALPSAKSLNTDPQSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEAEALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 8805 - protein, 387 aa, Gaeumannomyces graminis var. tritici
MLRSSAFALLAWASLSEAQFGIKHTQYGTSEPVYPSPEISGSGGWEAGLAKAKDFVAQLTPEEKANMVTGTPGPCVGNIAPVPRLNFTGLCLQDGPATLRQATYVTVFPGGVSAASSWDKDLIYKHGVLMAREFRDKGSHIILGPVIGPLGRSPYAGRNWEGFSPDSYLAGVLAEQTVKGMQSVGMQTCTKHYIGNEQEEQRNPTTVDGKGVEAISSNIDDRTMHETYLWPFYNAVRAGTTSIMCSYQRINGSYGCQNSKTLNGLFKTELGFQGFVVSDWAATHSGVASIEAGLDMNMPGPLNFFAPTLESYFGKNITTAVNNGTLSSRRVDDMIERIMTPYFALGQDKDYPPVDGSTVPIGYLQPDAWNHEFPLGPTVDVRRNHHE

SEQ ID NO: 8806 - protein, 203 aa, Oceanobacillus iheyensis HTE831
MILLIDNYDSFTYNLYQYISEFNKEVRVIRNDAITPNEIRAMHPEAIIISPGPGSPTKAGNCLKIVREVYREFPILGICLGHQVLAEALGGEIKQAKVIKHGKTSPISIKDSQLLHSLQHPIQVMRYHSLIVDRKSLSADYQVTARSLDDNEIMAIEHKQLPLFGMQFHPESIGTKDGKQIIKNFLIQIKALQEDENNEALTS

SEQ ID NO: 8807 - protein, 467 aa, Thermoanaerobacter tengcongensis
MNDVGLIGLAVMGQNFALNMARKGYRVSVYNRTPERTKKFVEEKVRDESIFPFYTIEEFVKSLKKPRKIILMIKAGKAVDDMIAEILPYLELGDLIVDSGNSHFADTARRLEYLSQKNILFLGMGISGGEYGALHGPSLMPGGTKEAYDLIKDILLKAAAKTEDGPCCTYVGKGSAGHFVKMVHNGIEYAIMQLIAEVYDFMKKVLNMTNEQIGDVFEKWNKGELNSYLMEISYKIMRYKDKETGGFLIDYILDKAEQKGTGKWTAQTSLDLGVPTPTLNLAVEARIISHYKEERKILSKLYSKEKNIISVNKEEMIEHLKKALLFGVFMSFSQGLWLIDEASKQYNYGIDLSEILRIWKGGCIIRAEILDFLRDIIRENEEDANLLHSDKAIDFIKDKLNSIYQVTEIGKNYRIPLMTMNSALDYYFALTEENLPANIIQAQRDFFGAHTYERIDREGIFHTEWER

SEQ ID NO: 8808 - protein, 218 aa, Aquilegia alpina
GGLIKKARELSVLCDAQLGLIIFSSSGKLFEFTSEDNSMQEILARYQKATGKSIKEYDNQCAQEVRHEMLRLRDQTDRLQASIRQYTGENLTALDYNDLNELEQQLEVSVDKVRARKNQLLQQQLDNLRRKEQILEEQNSHLYHSILEQQAAAEHHQAMMEHKVEHPMLEHFGLYATDEQARNLLQLSPLSPQLHTFRLQPTQPNLQERGLQYPDLQL

SEQ ID NO: 8809 - protein, 359 aa, Buchnera aphidicola str. Sg (Schizaphis graminum)
MKILNLIQPGVVTGNECQIIFELAKKKKFAIPAVNCIGTDSINAVLETASRVKSPVIIQFSYGGASFIAGYKRTSSKNPEDQAIQGSISGAQHVHLMSQYYQIPVILHTDHCSKEMLPWIDGLLEEGKKHYKNFGKPLFTSHMIDLSKEHLKENIAICSNYLKKIKKINMILEIELGCTGGEEDGIDNSNIDKKLLYTQPKDVNYAYKKLSKISTNFTIAASFGNVHGVYQPGNVNLKPNILKESQEYVSTKHNLKKLPLNLVFHGGSGSDLKEIHESIEYGIVKMNIDTDIQWASWKGVFNFYKKNKDFLQKQIGNKNGKNIPNKKYYDPRSWIRESQESMSKRLEKTFKDLNAFNIL

SEQ ID NO: 8810 - protein, 158 aa, Triticum aestivum
  unsure (1)..(158): unsure at all Xaa locations
MSPCPGCSLLPTRERLPLGPXYLMXLPVTRPRCGFPSTPNYDGAMNFMHRDEEVDYYPSRHAPLRHAEPASFPVPTRPVVGKREKTRIKKENDFVQPGERYRSWAPDRQDRFVRRFADALARPKVSHELRVIWIDFLSKCDKSCGMKVANRLNVKPSM

SEQ ID NO: 8811 - protein, 256 aa, Saussurea medusa
MVRAPCFDKHGIKRGAWSQEEDNKLRAHIQRSGHSNWRQLPKLAGLSRCGKSCRLRWVNYLRPTIKHGNFTKDEKDVVVALHNKLGNKWSAIAARLPGRSDNEIKNYWHTHLKNRAQTDQTVLQTKQDGNAETSKGKGTPKAGCVVRKPNVKSQQEVEILLAVLSSASSSSFSSSTTSDQNESSPPSLSVSDANVTPQCSEEAARSLCIDQFLVEEDSIMLSSDKMYSPLGSVDYFISQDNVMDDVLLWPNLDFYY

SEQ ID NO: 8812 - protein, 222 aa, Vibrio mimicus
AAGGIGQALALLLKNRLPAGSDLALYDIAPVTPGVAADLSHIPTPVTIKGYAGEDPTPALEGADVVLVSAGVARKPGMDRADLFNVNAGIVKALAETIAVVCPKACVGIITNPVNTTVPIAAEVLKKAGVYDKRKLFGVTTLDVIRSETFVAALKDKDPGQVRVPVIGGHSGVTILPLLSQVEGVTFTDEEVAALTKRIQNAGTEVVEAKAGGGSATFSMGQ

SEQ ID NO: 8813 - protein, 515 aa, Citrus unshiu
MASIGSLKVPSSPSTAATSSNSNNHSRRSVVKRLAFSSSQLSGDKIFSKAVTGDRRRERRRSLCLLQAVSDSKNSPLDPEASRRVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKLATAFGLMKIDEEGRIIEFSEKPKGEQLKAMKVDTTILGLDDARGKEMPFIASMGIYVISKDVMLSLLRDKFPGANDFGSEVIPGATSIGMRVQAYLYDGYWEDIGTIEAFYNANLGITKKPIPDFSFYDRSDPIYTQPRYLPPSKMLDADVTDSVIGEFCVIKNCKIHHSVVGLRSCISEGAIIEDTLLMGADYYETDADRRFLAAKGSVPIGIGKNSHIKRAIIDKNARIGNNVKIVNRDSVQEAARETDGYFIKSGIDTIIKDALIPSGTII

SEQ ID NO: 8814 - protein, 241 aa, Zea mays subsp. mexicana
SIRNNPVQNKLMNGEDPINNNHAQTAGLGVRLATSSSSRDPSPSDEDMDGEVEILGFKMPTEERVRKRKESNRESAGRSRYRKAAHLKELEDQVAQLKAENSCLLRRIAALNQKYNDANVDNRVLRADMETLRAKVKMGEDSLKRVIEMSSSVPSSMPISAPTPSSDAPVPPPPIRDSIVGYFSATAADDDASVGNGFLRLQAQEPASMVVGATLSATEMNRVAAATHCAGAMELIQTAMG

SEQ ID NO: 8815 - protein, 327 aa, Chlamydophila caviae GPIC
MSSQFEQLKLLSVLVCDTGDPELVKTSGSQDATTNPSLILKVAQEPKYQELLTEAIAWGIRQNGDDIQTLTFVLDKIQVNFGLEILKCIPGRVSLEIDARLSFNTEAMIQRAIFLSELFAATGGDKKRLLVKIPGTWEGIRAVEVLEKQGIACNVTLIFNLIQAIAAAKANATLISPFVGRIYDWWIAAYGDEGYSIDADPGVASVSNIYTYYKKFDIPTQIMAASFRSKEQVLALAGCDLLTVSPKLLDELKKDQSPVAKKLDVAAAKKLDVQPVELTESVFRFLMNEDAMATEKLAEGIRIFSGDTQILEAAVTEFIKQIAAQDA

SEQ ID NO: 8816 - protein, 466 aa, Arabidopsis thaliana
MASKSDVNIIETSSKVHFSGFHQMDGLASNRPEQMAEEEEHGQPFVIGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDADADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGSVYSGVDFCKKLCGVSVIRSGESMENALRACCKGIKIGKILIHREGDNGQQLIYEKLPSDISERHVLLLDPILGTGNSAVQAIRLLISKGVPESNIIFLNLISAPEGVNVVCKKFPRIKIVTSEIELGLNDEFRVVPGMGEFGDRYFGTDDE

SEQ ID NO: 8817 - protein, 177 aa, Streptococcus mutans
TSIMFDGSHLPVEENLEKAKEVVAKAHAKGISVEAEVGTIGGEEDGIIGRGELAPIDDAKAMVETGIDFLAAGIGNIHGPYPANWEGLDLDHLKKLTEAVSGFPIVLHGGSGIPDDQIRAAIKLGVAKVNVNTECQIAFANATRKFAAEYEANEAEYDKKKLFDPRKFLKPGFEAIT

SEQ ID NO: 8818 - protein, 95 aa, Zea mays
  unsure (1)..(95): unsure at all Xaa locations
YHTVWVPMPSVGFVAYGRSXETNDDGTAPERLKEHGILAKNEHRESXSMKELIPGAPLTLKIVLAQEEGKGLHADSDFHIRFQAFLMLRGKEAPL

SEQ ID NO: 8819 - protein, 265 aa, Pinus strobus
RENYTVMHLDLASLESVRQFVDNFRQSGRPMDVLVCNAAVYLPTAKVPTFTAEGFELSVGTNHLGHFLLSRLLLEDLKKSDFKSKRVIIVGSITGNTNTLAGNIPPKANLGDLRGLSARLNGVNSSPMIDGGEFDGAKAYKDSKVCNMLTMQEFHRRYHEETGITFASLYPGCIATTGLFREHVPPFRLLFPPFQKYITKGFVSEEEAGKRLAQVVSDPSLTKSGVYWSWNNDSASFENQLSEEASDPGKARKVWEISEKLVGLA

SEQ ID NO: 8820 - protein, 402 aa, Archaeoglobus fulgidus DSM 4304
MRALVVELRLWKAALSLLLGKVTKSVYYSPLSLLKYYKNYPEPALPDEDWVKVKTRLCGICGSDLRIITLQESFYLAPLTSFPFIPGHEVVGEVVEVGKEADAQEGERVVINTALSCRVRGFDDCDACRKGHFAACHNVDRGRISPGIFTGTCRDTGGGWAEYFVAHESQLVRVPEGIRDENAVFAEPLTIGIHSALRSFPDDGEVVAIVGCGVIGICTIIALRHLGFRGEIIGIDISERQAELARKFGADGVVTENPVERIAEMTGGRVYRPPRDKPMFIGGGVDVAFECTGIPQTVDTALRITKPLGRVVIAGTVAKMGVDWAPVFAKELSVLGTFGCGIEEVNGEKRDAFDIAFEILKKVDLSSLLTHRFTIEDYKKALRAAIEKGKSGAVKVAFDFTL

SEQ ID NO: 8821 - protein, 110 aa, Oryza sativa; identical to SEQ ID NO: 6810

SEQ ID NO: 8822 - protein, 160 aa, Triticum aestivum
MGSEGSAPVVVPRNFRLLEELERGEKGIGDGTVSYGMDDADDIYMRSWTGTIIGPPNTVHEGRIYQLKLFCDTDYPDKPPTVRFQARVNMTCVNQETGMVDPRRFPMLGNWKREHTMEDILISLKKEMSTPQNRRLHQPHEGNDDQRVEQKGLAARCVVM

SEQ ID NO: 8823 - protein, 439 aa, Zea mays
  unsure (1)..(439): unsure at all Xaa locations
SGIFRLGWKDRERLSESSCSYCLQPLPSLHYRSQKRXDIFLCSDCFHDAMNITGHSCLDFQRVDGDNDESENDSDKWTDEETLLLLEGIEKYNDNWDDIAGHVGTKSKAQCIYHFIRLPVEDCLLENVEIPNAPIPFRPQSNGYQCLDSNGSTSGAPVQNIQQGNELPFINSSNPVMSLVAFLASSIGPRVAASCAHAALSFLTRDEDSRVSSEGSHAGGLGNGANPNFQNHNGASPSISPENVKYAAMLGLSAAAMKSKLFADQEEREVQRLTATVINHQLKRLELKLKQFAEVETLLLKECEQVERVRHRISAERVRMRSALLGPTGSGLPGGSCSTMPSNPAGMSPRPVGVPGYMPQTSMPATYANNLQGHGNPQMPFLHQRPQMLSFGPRLPLSAIQTQPSPQSSNMFNSGMPNSIAPNHHQLLRSSSGNNSSAG

SEQ ID NO: 8824 - protein, 205 aa, Zea mays
LIMRFSTVIHERGSPETIRDPRGFAVKIYTREGNWDLLGNNFPFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRN

SEQ ID NO: 8825 - protein, 176 aa, Zea mays
  unsure (1)..(176): unsure at all Xaa locations
MATKEDGEDPRIPKIASSIRGIPDFPKPGIMVQDITTLLLDTEGFKDTGDIFGGRYKGKGISGGGGGEARGFIFGXPPVGVAIGGKFGPMRKPKKLPGKVISEEYSLEDGTDKIEMHVGAGEPGERAIIIDDLIGTGGTLAAGIRLLERVGVAIAECACVIESPXVKGREKLGETP

SEQ ID NO: 8826 - protein, 172 aa, SYNECHOCOCCUS SP. WH 8102
MDLQTYIRSIPDFPKPGILFRDINPLLRNPAAMVEVMRRLGAICDAVQPDLIVGIESRGFIVGTPLALQRSLGFVPVRKPGKLPGAVIGVDYALEYGTDRLEIQSDALTGNPRVLVVDDLLATGGTAAATGSLVRAAGGELVGFAFVIELEPLGGRSALPDEVLAESLIRYP

SEQ ID NO: 8827 - protein, 267 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDHESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 8828 - protein, 393 aa, Oryza sativa
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLEFESLTITEILNHLIHNQNEYCMEVTPKTLADVKGGTLISYEGRVQLLEIAQVPDEHVNEFKSIEKFKIFNTNNLWVNLKAIKRLVEAEALKMEIIPNPKSDLYTLVDGFVIRNPARTNPSNPSIELGPEFKKVANFLARFKSIPSIVELDTLKVSGDVWFGSGVTLK

SEQ ID NO: 8829 - protein, 361 aa, Cryptococcus neoformans var. neoformans
MSSDSSSSQVPRFHVHPHGAHLDHPAPPIQAGESSLALEEEEEHDYESLPVGSGWAVNMAAGAMAGISEHSAIFPIDSIKTRMQILAPVLHPVTGTTSATITGTIAPQLNTISQHVRSISTTEGLRSLWRGVASVILGAGPAHAAHFGMYEFVREISGGRNDGWQGVMGTAVAGAAATVSSDALMNPFDVIKQRMQIANSPYSNVLHCARTVYAREGLTAFYVSYPTTLTMSVPFTAVQFSAYEYLKTLLNPSGSYSPSTHVIAGGIAGGLAAAVTTPLDVAKTLLQTRGSSADERIRGARGMGEALRIIWERDGWKGLRRGMAPRVLTVAPSTAISWMSYEFFKVLIRQHGSLPETGQSL

SEQ ID NO: 8830 - protein, 467 aa, Bacillus licheniformis
MRNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKAKGIGYLGIGISGGEVGALKGPSIMPGGDRDVYEKAAPILTKIAAQVEGDPCCVYIGPKGAGHFVKMVHNGIEYADMQLIAEAYTFLREKLLLPIDEIADIFDTWNQGELKSYLIEITAEILRKKDERTGAPLIDVILDKTGQKGTGKWTSLQAIDNGIPSSIITESLFARYLSSLKDERTAAENVLAGPETEERPLDQNVWIDRVRQALYMGKVCAYAQGFAQYKMTSDLNGWHLPLKDIALIFRGGCIIRAQFLNLISEVYDKQPDLSNLLVAPDFAEKLKEYQSGLRKVVCEGISSGISFPCLSTALSYYDGYRTGRSNANLLQAQANYFGAHTYERTDMEGVFHTDWY

SEQ ID NO: 8831 - protein, 331 aa, Triticum aestivum
MTLDALCAAGDVLVYDTFNAAAAVSAAPAESSLLFCDVAGAAWMAGSAAAEAPAVTIVPVEEGEKAQGRRKRRRRARSCKNREDAESQRMTHIAVERNRRRQMNEYLAVLRSLMPESYAHRGDQASIVGGAIDFVKELEQLLQSLEAQKRTLLAQPQQEHKPLPIRDAMPSSSKTVTAAATTTTSSGSGEGKQASAMREGMGPPFAGFFTYPQYVCRLPPRDDADDRAGAADIEVTLVETHANVRVMAPRRPGQLLRMVAGMEALRLTVLHLNVTTLGSLALYSLSVKVEEGCGPTTADDIAAAVHHVLCLVDAEATSQRLLAGGQQEILS

SEQ ID NO: 8832 - protein, 164 aa, Zea mays; identical to SEQ ID NO: 4781

SEQ ID NO: 8833 - protein, 224 aa, Petunia x hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQCSKMHKMWATADKQLKLREMASFILWNVNPLYKLGIKMIQLQ

SEQ ID NO: 8834 - protein, 342 aa, Zea mays
  unsure (1)..(342): unsure at all Xaa locations
MISLTKLLSSALHGYHSCSIRRFSWFAALGEHQFAVANFSKFVTRLVRQKSSCVCWRLNQKTCGXLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 8835 - protein, 337 aa, Zea mays; identical to SEQ ID NO: 7167

SEQ ID NO: 8836 - protein, 400 aa, Zea mays
  unsure (1)..(400): unsure at all Xaa locations
MARSWLITCRGIAKKIRYANPSANHHISELIAEARRECPNCSYIIDNSDVAMQWPGXLPAGVKFDPSELELLQHLEQKVGLGDSRPHVLIDEFIPTIDNDEGICYSHPENLPGMKTDGSNAHFFHRVSKAYGCGQRKRRRTINCSDHTVSDEHVRWHKTGRSKAIYENGVIKGWKKIMVLYKISRRGRKPDRANWVMHQYHLGKEEDEKDGELVVSKIFCQLANKSMEISETETACEEPGAPASVIGPKTPKTITPQPRHPKNSPCETEQSISILQDQLLLDSEDEPTMPIVSLEDDAMNPAWCAVAEEEQVVGEASRAQSNSDEPLLCREDPNSLNDEALLPWDYPILSQCRSEIFDRNLNGYGLPDLHNVDLGTPPDLQLADFQFGSQESLGSWLDRI

SEQ ID NO: 8837 - protein, 71 aa, Zea mays
ILCRFRFVEKCKYPEDGSPPRSLRYIGSMVADVHRTLLYGGIFLYPADQKSPNGKLRVLYEVFPMSFLMEQ

SEQ ID NO: 8838 - protein, 363 aa, Yersinia pestis KIM
MLAAFLHLEIYSVYRWATYERHQSRLIIGMASSSRLHDVLPVYSLCLMVSGDGMYQEIVCIRRLHVSGERMKGIILAGGSGSRLHPITRGVSKQLLPIYDKPMIYYPLSVLMLAGIRDVLIISTPEDLPSFQRLLGNGDEFGINLSYAAQPSPDGLAQAFIIGEAFIDNEPCCLVLGDNIYFGQGFSPKLKAVAARQQGATVFGYQVMDPERFGVVEFDDNFRALSIEEKPSQPKSNWAVTGLYFYDNQVVDFAKQVKPSARGELEITSINQMYLDRGELTVELLGRGFAWLDTGTHDSLIEASTFVQTVEKRQGFKIACLEEIAWRNGWLDDDGVKRAATALAKTGYGKYLLDLLHARPRQY

SEQ ID NO: 8839 - protein, 162 aa, Moraxella catarrhalis
MYAEDTKNIVEIKDIIAREILDSRGNPTIEADVILANGIRGRAAAPSGASTGSREALELRDGDTSRYLGKGVKKAVANANSQIRTVLLDKDVTQQTQIDNILIELDGTENKGNMGANAMLAVSLAVAKAAAIAQSLPLHQYIANLRGQTSLTMPVPMMNILN

SEQ ID NO: 8840 - protein, 778 aa, Nostoc punctiforme
MQEDFRLIVDLVLVLGVAACGGLLAALLRQPVLLGYLIGGMIVGPAGLGLIKEVIQVETLAQFGVAFLLFALGVEFSFAELKKVKAIALGGGGLQIALTILVTVVVSGLSGAWGTLPAKGMFLGCILSLSSTAVVLKCLMERNETETPHGQVMLGILVVQDLALGLMLAVLPALNQPAETIGIAVLTALLWIALFAAGAVAAGMWLIPPLLRLLARTESRELFLLGVVALCLGIALLTEHLGLSIEMGAFVAGLMISEVEYADQTLTYVEPLRDIFASLFFAAIGMLIDPVFLWNNLELILGLVALVFIGKFLIITPLVKLFRYPLKTAIIAGLGLAQIGEFSFVLASEGQSLGLVSRQIYLLILGTTAVTLMLTPFVLRLVPFLFNFAESMPWLKPYLEEQEALDVSEDLPFKDHVVVCGYGRVGKNLVKLLLQHNLPVVVIDQSESRIQQLREAGVSYVYGNCVSLHVLETAGVNHAKGMAIALPDPMSTRLCLKRALELRPELDLVVRATQDKNIEVLYQLGAREVVQPEFEASLEMATYLLTGLGLLSSAVVQREMQQIRNDHYLDLRPERSATEVARDLRQATRDLNQRWYPLPADSPLIGMSIEEADMRYLTGASLMAIRRANGDEIDYPNNQTKLEDGDRLLVVGADEELAALAEFAKGQAAVPGENSACQWVTVNADTPTLGKTLADLDINKQFGVQVQAIRRDGKFIRYPDGGMDLRVGDQVLLCGSLTGLSQIEQLFAIASSLPLSLPVLKAVQAEALKEFLPADSVD

SEQ ID NO: 8841 - protein, 182 aa, Manihot esculenta
MASSMLSTATVASINRVSPAQATMVAPFTGLKSTPVFPTTRKTNSDITSITSNGGKVQCMKVWPTLGMKKFETLSYLPPLTREQLASEVEYLLRSGWIPCLEFELEHGLVYREHARVPGYYDGRYWTMWKLPMFGCTDAAQVLKELDELIKHHPDGYARIIGFDNVRQVQCISFLAYKPPGA

SEQ ID NO: 8842 - protein, 435 aa, Streptococcus pyogenes M1 GAS
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 8843 - protein, 222 aa, Thermobifida fusca
MAIQISPSILSADFARLADEVEAVAGAADWLHVDVMDNHFVPNLTLGLPVVESLLKVAPLPLDCHLMIEDPDRWAPAYAEVGAQSVTIHAEAAKAPVRTLRAIRAAGARAGLALNPATPVDGYADLLGEIDMLLVMTVEPGFGGQKFLDLVLPKIRRARELIRNADASVWLQVDGGVSAETIERCAEAGADVFVAGSAVYGEKDPAAAVEHLRALAERATAR

SEQ ID NO: 8844 - protein, 184 aa, Triticum aestivum
MAKMARSTRRTSNLNSTLLLLSLLLLTCFFQQASGHGGVDHGDGDEDDEGHHGDVGVRGGGLRSRGLIAVKVWCLVILLVFTFLGGVSPYFYRWNEAFLLLGTQFAAGIFLGTALMHFLAGSTFTFNALTHSPYPFSFMLACAGFLLTMLSDVAIVAVANRQRVNQAAPIQKDAEEEGESTSAG

SEQ ID NO: 8845 - protein, 335 aa, Thermobifida fusca
MTIRVGVNGFGRIGRNFWRAVQAAGGSDVEIVAVNDLTDKATLAHLLKYDTVLGTLPGEVEVGEDSITVGGTTMKALAQRDPAQLPWGDLGVDIVVESTGFFTKAEDAKKHLDAGAKKVIISAPAKGEDLTVVMGVNDDKYDPANHHILSNASCTTNCVAPMAKTLMENFGIVKGLMTTVHAYTNDQVILDYPHKDLRRARAAAQNIIPTTTGAAKATALVLPELKGKLDGLAMRVPVPDGSVTDLVVTLEREVTKEEVNAAFKAAAEGALKDILVYTEDPIVSSDIVGTPASCTFDASLTMAFGTQVKVVGWYDNEWGYSNRLVDLVKLVGSNL

SEQ ID NO: 8846 - protein, 365 aa, Vanilla planifolia
MATWVEHQQQQNGSKDVDEEACMYAMQLSSMVVLPMTLRVAVELGILEQIQAGGPDSYLTAEDLAARLGNSNPLAPVMIERILRLLTSYSILNFTDTVDGEGRTVRSYGAAHVCKYLTPNQDGVSMAPLVLMNTDKVLMESWYHMKDAVTNGGIPFNLAYGMTAFEYHGKDLRFNKVFNEGMKNNSIIITKKILERYKRFEDVNVLIDVGGGIGGTISMITAKYPHIHGINFDLPHVVSEAPPFQGVEHVGGNMFESVPIGDAIFIKWILHDWSDEHCLKLLRNCAKSLPDKGKVIVVECILPDAPLVTPEAEGVFHLDMIMLAHNPGGKERTKKEFKELAMLSGFSNFKALFSYANVWVMEFNK

SEQ ID NO: 8847 - protein, 883 aa, Oryza sativa
  unsure (1)..(883): unsure at all Xaa locations
MAADLPRRFPSFPGRPLSPRLYLNPPRTSSVRFRLSPPFLLAGIELPPSLSLSAVAAELRSAAVVAPDHLPPQRRLLRLRRILADLVHPFVSLTDRRNAVDPVDPSRAAAFLRSRRLFRRRRRPRVSRGPPPLFPLPFPSLGRRSAVPMAAAGDHRGAGAASRLLRRLGRPRARRVAAAWGPAVSRPRPRLRLTRGAHGAGRCEPGCTRSTVDREATAWAPLPWTRLCRTIISSSLSRTIIVGRVLRWDDSNGLMHTTHRSNIHAFLKNCYKSSPSAVVASAAALLRCRPAPPPPSPAPPPCSGTEACSAAVDCAGAVACAASKKLGFRLGLRFSLSDATAKQRAERETDRATPPRAMASESESNGHHHAGDEARAENSGAGCLHGGDDGGGTPRTTPEIRYTKLFINGRFVDAASGKTFETRDPRTGDVIARVAEGDKEDVDLAVKAAREAFDHGEWPRMSGSERGRVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQVKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGXKMSGFGKDDSMHALDKFLAVKSVVTPVHGSPWF

SEQ ID NO: 8848 - protein, 756 aa, Oryza sativa; identical to SEQ ID NO: 5683

SEQ ID NO: 8849 - protein, 293 aa, Rhodospirillum rubrum
MVPGHEIIGTVSAVGAKVSGFKVGDRVGVGCMVDSCRECAPCKADLEQYCEDGATLTYNGRDRHDHSLTFGGYSERIVVSEAFVLRLPDALDAKSAAPLLCAGITTYSPLRHWQVGPGSRVAVIGLGGLGHMGLKLAKAMGAEVSLFTRSPGKEDEAKRLGADHVVLSTDEARMKAVAGHFNLIIDTVPHPHDLNPYVSTLALDGTLVLVGLLGPIEPVIDSVPLVIGRRAVAGSAIGGIAETQEMLDFCAAKGVTADVEMLDINNINAAYDRMLKSDVRYRFVIDMATLRGA

SEQ ID NO: 8850 - protein, 301 aa, Triticum aestivum
GVLILSGDHLYRMDYMDFVQSHRQRDAGISICCLPIDGSRASDFGLMKIDDTGRVISFSEKPRGADLKEMEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 8851 - protein, 477 aa, Streptomyces avermitilis MA-4680
MATAPSVSYSMTVRLEVPASGTAVSQLTTAVESHGGSVTGLDVTASGHEKLRIDVTIAATSTSHADEIVAQLRTIEGVTLGKVSDRTFLMHLGGKIEMQSKHPIRNRDDLSMIYTPGVARVCMAIAENPEDARRLTIKRNSVAVVTDGSAVLGLGNIGPKAALPVMEGKAALFKRFAGIDAWPLCLDTQDTDAIVEIVKAIAPGFAGINLEDISAPRCFEIEARLREALDIPVFHDDQHGTAIVVLAALTNALRVAGKAIGDIRVVMSGAGAAGTAILKLLIAAGVKNAVVADIHGVVHADREDLVNAAADSPLRWIADNTNPEGLTGTLKEAVRGADVFVGVSAPNVLDGDDVAAMAEDAIVFALANPDPEVEPAVARQTAAVVATGRSDFPNQINNVLVFPGVFRGLLDAQSRTVNTEMMLAAAAALADVVTEDELNPNYIIPSVFNEKVAGAVAGAVRTAAKAAGVTESDSKDA

SEQ ID NO: 8852 - protein, 239 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMA

SEQ ID NO: 8853 - protein, 198 aa, Buchnera aphidicola
MANILLLDNVDSFTYNLVEQLRNQNNQVLIYRNTVDIEVIFDALKKLKNPILMLSPGPSIPQYAGCMLPLIKKVKGYLPIIGICLGHQAIVEAYGGMIEYAGEIFHGKASLINHDGLEMFKDIPQPLPVARYHSLVACKDIPNNFIINSFFKKTIMSIRNNKDRVCGFQFHPESILTTCGDQILKQIIYWASLKYVMK

SEQ ID NO: 8854 - protein, 630 aa, Dechloromonas sp. RCB
MGSHEQTADVTGQRFAALALAALGVVYGDIGTSPLYAVKEVFAGNHPIPVTMLNIYGSLSLIFWALVIVVSVKYVTFIMRADNRGEGGIMALIALALHTVHDKPQHAKWIMIVGVLGAAMFYGDGMVTPAMSVLSAVEGLEVATPALKPFVIPLTMVVLFILFFVQRSGTATVGAFFGPVMLVWFSALALLGVHNIVDHPAILMALNPAYGIEFLLENKAHSLVAMGNVVLAVTGAEALYADMGHFGRKPISRAWFAFVLPALVLNYFGQGALILGDPEAAKNPFFLSAPDWALYPLVGLATLATVIASQAVISGAFSVTRQAMQLGFVPRMEVQYTSDREQGQIYLPAVNWGLMVAVMILVLGFRSSNNLAAAYGIAVTGDMVITSILATVVVAKVWKWGWFKAGLLFACFLSVELVFLAANILKIPDGGWFPLVAGMGVFVLMTTWKRGRQLLSDRLRGERLELSMFLDSLASSMPTRVAGTAVFLNADPKGVPHALLHNLMHNKVLHERVVLLSVQFFDVPYVPDIDLVEVRQLKENFWSVVIQYGFKDIPNVPEALALCADAGLAFSSLETSYFIGRETLIPRLGSEMAFWREKIFVAMFRNAGSATAFFKIPSNRVVELGTQVVL

SEQ ID NO: 8855 - protein, 257 aa, Oryza sativa
MAKLGPGQGLGCEAAVGLLAPSRKREYKACNKLTEGKRPLYAIGFNFLDFHYYEVFATVGGNRVTTYSCLKDGNFAILQAYIDEDKDESFYTLSWACDLDGTPLLVAAGSNGIIRVINCATEKLLKDESVRLWNVHTGICILIFAGAGGHRNEVLSVVLVAVVHSNYVDCTRWLGDFILSKGSIDILQKYPVPECDIWFIKFSCDFHFNQLAIGNREGKVFVWEVQSSPPVLTARTILACSEDGSIWRWDEVDHPKA

SEQ ID NO: 8856 - protein, 198 aa, Bradyrhizobium japonicum
MIVIVDNYDSFVFNIARYFHKLSEATEVIRNDAISISELVGLNPRAVVISPGPCTPTEAGISTAVVRELSGRVPILGICLGHQCIASVFGGRVARARRPMHGRRSYVAHDGRGLFKGLPTPLDVGRYHSLIVALDQSCAQNLVVTARSEEGEIMALTHGYYPTYGVQFHPESILTSQGHVLLKNFLRLAQDFRNRAEQ

SEQ ID NO: 8857 - protein, 254 aa, Petunia x hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 8858 - protein, 456 aa, Archaeoglobus fulgidus DSM 4304
MYRVKTFKYYSTYKICMIEEVFELTQNGRAKKWHAFYGGKIEILPKVPIRTLDDFSIWYTPGVAEVCNEIAEDEEKAYDYTNKWNLIAIITDGSRTLGLGNIGPKAAMPVMEGKALLFKFLGAVDAFPIALAEQDADRFIEIVKAISPTFGGVNLEDISSPKCFYILERLQKELDIPVWHDDQQGTATATLAALINALKIVGKDISEVKISIIGVGAANFATIRLLKAAGADPKKMFVVDSKGILHPDRADLKEKKGYKWQVAIETNGERRTGGMEEAIRGTDVLIAASKPGPDVIKKEWIAEMNDDAIVFPLANPTPEIWPWEAKDAGARIVGTGRSDFPNQVNNSLVFPGVFRGALTVRARKITDEMCLAAANALAEFAERNGLSEDYIIPRMTEKEVFPEVATAVGVKAVELGLARLELREEEIYEIAELMISATQRKIKKLYELGFIKEPPS

SEQ ID NO: 8859 - protein, 196 aa, Exodictyon incrassatum
GGAKKVVISAPSKDAPMFVMGVNEDKYTNEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDTIKAALKEASQGKLKGILGYTEDEVVSSDFITDSRSSIVDAKAGIALSDTFVNL

SEQ ID NO: 8860 - protein, 435 aa, Methanothermobacter thermautotrophicus str. Delta H
MSYQGRARKFLESASIDVGDMVLVEKPDVTYEGMVLDRADDADDRHIVLKLENGYNIGVEISDARIELLEKGSEPRIELPPVEAAEDPELPDVSIISTGGTVASIIDYRTGAVHPAFTADDLLRANPELLDIANIRGRAVFNILSENMKPEYWVETARAVYGEIKDGADGVVVAHGTDTMHYTSAALSFMLRTPVPVVFTGAQRSSDRPSSDASLNIQCSVRAATSEIAEVTVCMHATMDDLSCHLHRGVKVRKMHTSRRDTFRSMNALPLAEVTPDGIKILEENYRKRGSDELELSDRVEERVAFIKSYPGISPDIIKWHLDEGYRGIVIEGTGLGHCPDTLIPVIGEAHDMGVPVAMTSQCLNGRVNMNVYSTGRRLLQAGVIPCDDMLPEVAYVKMCWVLGQTDDPEMAREMMRENIAGEINERTSIAYFRG

SEQ ID NO: 8861 - protein, 172 aa, Zea mays
AEIGLLATVGVTTVKVYPRPTIAVFSTGDELVQPATATLSRGQIRDSNRAMLLACAIQQKCKVVDLGIAEDTEESLKEHMDAALRSNADIIITSGGVSMGDRDLVKPCLAKMGKIHFEKIQMKPGKPLTFAEITTQDTPKPSKTVLAFGLPGNPSFTVQQLDGCLMMDLVDL

SEQ ID NO: 8862 - protein, 595 aa, Oryza sativa
MAPWSGLWGGKLAAGESPVLRSRFYAFIRAFVVLSVLLLIVELGAYINGWDDLAASALALPVIGVESLYASWLRFRATYVAPFIQFLTDACVVLFLIQSADRLIQCLGCFYIHLKRIKPNPKSPALPDAEDPDAAYYPMVLVQIPMCNEKEVYQQSIAAVCNLDWPRSNFLVQVLDDSDDPTTQTLIREEVLKWQQNGARIVYRHRVLRDGYKAGNLKSAMSCSYVKDYEFVAIFDADFQPNPDFLKRTVPHFKDNDELGLVQARWSFVNKDENLLTRLQNINLCFHFEVEQQVNGIFLNFFGFNGTAGVWRIKALDDSGGWMERTTVEDMDIAVRAHLRGWKFIFLNDVECQCELPESYEAYRKQQHRWHSGPMQLFRLCLPDIIKCKIVFWKKANLIFLFFLLRKLILPFYSFTLFCIILPMTMFVPEAELPDWVVCYIPALMSLLNILPSPKSFPFIIPYLLFENTMSVTKFNAMISGLFQLGNAYEWVVTKKSGRSSEGDLISLAPKELKHQKTESAPNLDAIAKEQSAPRKDVKKKHNRIYKKELALSLLLLTAAARSLLSKQGIHFYFLLFQGISFLLVGLDLIGEQIE

SEQ ID NO: 8863 - protein, 358 aa, Dechloromonas sp. RCB
MKICVIPGDGIGVEICAEAVRVIDALKDIHGLKIEYEYGLLGGAAYDQTGRPLPVETLRLADEANAILLGAVGGPKWDKLPAESRPERGLLGIRKYLGLNANLRPIKVYPELANASTLRPEVVSGLDMMIVRELTGDIYFGQPRGIRTSGFERVGYNTMEYSESEIALIAEMAFRIARQRSGKVMSVDKMNVLECMQLWRDVVTKVGERFPDVTLDHMLVDNAAMQLVKNPKQFDVLLTGNMFGDILSDEAAMLTGSIGMLPSASLNVEDKGMYEPCHGSAPDIAGQGVANPLGMILSAAMMFRYSLGRPDMADAIESAVQTVLTNGARTRDIFQAGDRLVSTSEMGGLVEAALRRIS

SEQ ID NO: 8864 - protein, 398 aa, Arabidopsis thaliana
MESELKDLNSNSNPPSSKEDRPLLKSESDLAAAIEELDKKFAPYARTDLYGTMGLGPFPMTENIKLAVALVTLVPLRFLLSMSILLLYYLICRVFTLFSAPYRGPEEEEDEGGVVFQEDYAHMEGWKRTVIVRSGRFLSRVLLFVFGFYWIHESCPDRDSDMDSNPKTTSTEINQKGEAATEEPERPGAIVSNHVSYLDILYHMSASFPSFVAKRSVGKLPLVGLISKCLGCVYVQREAKSPDFKGVSGTVNERVREAHSNKSAPTIMLFPEGTTTNGDYLLTFKTGAFLAGTPVLPVILKYPYERFSVAWDTISGARHILFLLCQVVNHLEVIRLPVYYPSQEEKDDPKLYASNVRKLMATEGNLILSELGLSDKRIYHATLNGNLSQTRDFHQKEE

SEQ ID NO: 8865 - protein, 551 aa, Arabidopsis thaliana
METAKAWLSKLKSKDKVKSSKKKEATSNVKEGPKTAGGEEALSNITKEKAAAAKLYIENHYKMQMQSLQERKERRKMLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFEDETSGGTTTHQGSFLNLLPTQIEDPEKEGSKSSSSG

SEQ ID NO: 8866 - protein, 228 aa, Zea mays
MAGTSSWSSSSSCASSFGSPDHDVVCVTEPDSVGAAAVAVADAEGSVKFLCSYGGRILPRRTDGTLRYVGGDNRVLSVDRPIRFYVLQRKLRELCGGWEAHLRCQLPTEDLDALISVTCDDDLAKLLEEYDEASKDRLQSLKIRAFLFPTRTPAPSILQRRSPPSIAHLHWQNTSPPAAAGVSLTCAPRWWAGPQASRQAQAPQAQNYDRHSLGEERPRLYYSYMPRT

SEQ ID NO: 8867 - protein, 137 aa, Salmonella typhi
MANQPSAEELKKKLSEMQFYVTQDRGTEPPFTGRLLHNKRDGVYHCLVCDTPLFHSHTKYDSGCGWPSFYQPVSEEAIRYIDDFSHGMQRVEIRCGNCDAHLGHVFPDGPQPTGERYCVNSASLAFSDEKNGDQLKG

SEQ ID NO: 8868 - protein, 372 aa, Synechocystis sp. WH 8501
MDLISTFIFLSSGLFLGWSLGANDASNVFGTAVGSRMIRFSTAAVICSVFIIIGSVTAGAGAAGGLGKLGAVNALAGSFTVALAAAITVLWMTQLGLPVSTSQAVVGAIVGWNWFSDSPTNINDLIKIMGTWIACPILAAIFAAVIYKLVVLLIDNTKPHLLSLDNNIRWGLIIVGAFGSYTLGANNIGNVMGVFVPSSPFENLKIAGIFDISAVEQLFLLGAIAIAVGVFTYSKQVMMTVGGSLMTLSPVGALVVVLANSLVLFTFSSQELSNFVVSLGLPPIPLIPVSSSQAVVGAVIGIALLKGIKGVRQVKWGVLGGIASGWITTPVIAAVISFVLLFIVQNVFNQEVYQVASVQVSKPVIEILGDKL

SEQ ID NO: 8869 - protein, 561 aa, Geobacter metallireducens
MLTFIQLNRNIRSLRRYRQIVRVLFKFGFDHALELMGLSQFVARGRKLFRRPASELALLSPAERMRLSLEELGPTFVKLGQILSTRPDVIPRSFILEFAKLQDQVPSFPFEAVEDQIRKHLGREPSECYSFIDSEPLAAASIAQVHRARLVSGEDVVIKVRRPGVVGLVETDVDAMMGLAMLAERHLPGSDLYDPVGLVKEFARTIRREMDFSREAHTIEKFAENFAGDPTLHFPTVYWGQTAGGVLTMEHVDGIKVSDTAALDAAGLDRKLLARRGADAFLKMVLIHGFFHGDPHPGNVLILPNNVICLLDYGMVGRLDTQLKGYLTDILLAIVQRDVDEVISLLLYSGDITDTLDTRALRRDLSGLIDSYYEVPLQQIEVGRMLLEFLEVITTYHIRFQPDLMLLAKALVAIEGMGRELDPDFDMVEHLRPFMKKALRDRFSPEHLVREMGSHITSYVTLFRNLPKDLKEFLNRINRNKFKIDLEHRGLDRALRDFDKSINRLSSSLIIAALIVGSSIIMQTDKGPKIFEFPIFAFMGYTIAGFIGLWWVFAIIRSGRL

SEQ ID NO: 8870 - protein, 480 aa, Pseudophycodrys pulcherrima
QAIKNERYESGVIPYAKMGYWDPNYVIKETDILALFRVTPQPGVDPVEASAAVAGESSTATWTVVWTDLLTACDLYRAKAYKVDAVPNVSDQFFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEEIYERAEFAKALGSVIIMIDLVIGYTAIQSMAIWSRRNDMILHLHRAGNSTYSRQKVHGMNFRVICKWMRMAGVDHIHAGTVVGKLEGDPLMIKGFYDTLLLTHLDINLPLGIFFTQDWAALRKVTPVASGGIHCGQMHQLLDYLGDDVVLQFGGGTIGHPDGIQAGATANRVALESMVIARNEGRDFVTEGPQILRDAAKTCGPLQTALDLWKDITFNYTSTDTPDFVETPTASV

SEQ ID NO: 8871 - protein, 479 aa, Chondracanthus chamissoi
GIKNERYESGVIPYAKMGYWDPDYVVKDTDVLALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKGRYLYSMEGVNRSIAAAGETKGHYLNVTAATMEEMYERAGFAKELGSIIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 8872 - protein, 478 aa, Clostridium perfringens str. 13
MAEQHNEPKKLGFAQLAALIVGSMIGGGAFNLPSDMARGAGTGAVIIGWIITGIGMIALAFVYQSLANRKPELTGGVYSYAKAGFGEYIGFNSAWGYWLSAWIGNVSYSVLLFGAVGYFLPMFGAGNNVASIIGASVLLWAFTLLILNGVSGAALINLITTIAKLVPIFLFIVISLFMFNFDKFTFQFWGTSDLGGIVTQVKSTMLVTLWCFIGIEGAVVVSGRAKKQSDVGKATVLGLIGTLIIYMLITLMALGVMDRVKLSGLENPSMAYVLEFAVGKWGAVLINLGLIISLFGSLLGWALLAAEIPYVAAKDGVLPKVFAKLNKKGTPSGSLIITNLLVQAFLILTLVASSTYQALYSVASTAILVPYLLSAMYGFKLALTGETYDKNPTGRTRDKIFGGIATVYAIWLCYAAGLKYLLLCFILYAVGIIFFYIGKKQNNKDAEVFVGKEKILAIIVLVIAIIAIVMLFNGTITI

SEQ ID NO: 8873 - protein, 184 aa, Desulfovibrio vulgaris subsp. vulgaris (strain Hildenborough)
MTPRPLRTLLVDNRDSFTCNLEHLLARATGTPPVVLRHDRLPEMQPEAHDLVVISPGPGAPEEYPGYGRVIDSRVPVLGICLGMQILNMHFGGVTAPLDGCVHGKTDTALFDDGRTFTVARYHSLHVVTPGEGLRVCARTPAGLVMALRHESRPLMGYQFHPESFLTPDGVTLIHHALHTLRLR

SEQ ID NO: 8874 - protein, 488 aa, Vaucheria geminata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKLGTIIVMIDLVIGYTAIQSMAIWARKADMILHLHRAGNSTYARQKNHGINFRVICKWMRMAGVDHIHAGTVVGKLEGDPLMVKGFYNTLLDTKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 8875 - protein, 120 aa, Beta vulgaris
VSEEYKLVPDTLYLTVNLIDRFLSGNYLEKQKLQLLGVTCMLIASKYEEVSAPQVEDFCYITANTYAREEVLNMERKVLNFLCFQLSVPTIKTFLRRYVHAAQATEDSLVDLEFLAKYLV

SEQ ID NO: 8876 - protein, 352 aa, Oryza sativa
MVTKKINDVCCAGLLPNGNFEEGPPKSDLVNGTVVRGANAIPRWETSGFVEYIESGHKQGDMLLVVPQGAHAVRLGNEASIRQRLAVTRGAYYAVTFSAARTCAQAEQLNVSVSPEWGVLPMQTIYGSNGWDSYAWAFKAKMDEVALVIHNPGVEEDPACGPLIDGVAIRALYPPTLAKGNMLKNGGFEEGPYFLPNASWGVLVPPNIEDDHSPLPAWMIMSSKAVKYVDAAHFAVPQGARAVELVGGKESALVQEVRTVPGWTYRLSFAVGDARDGCAGSMVAEAYAARASIKVPYESKGTGGYKRAVLEFAAIANRTRVVFQSTFYHTMTDGSLCGPVIDDASLVGLRKK

SEQ ID NO: 8877 - protein, 517 aa, Triticum aestivum
  unsure (1)..(517): unsure at all Xaa locations
TGWLPPFSLPGLRRAGTGTVALFAGPGHVTAAPIRLAFVGVIYPCLVLQYMGQAAFLSKNMSDVHDSFYLSIPRTVFWPMFVLASLAAIVGSQSIVSATLRRSKQCLSLGCFPRVKVVHTSRWIYGQIYIPEINWILMVLCLAVTVGFRDINIIGNAYGLACITVMFAHISLIEVGMIYYVXCNFPVWSFGMIVSVSDLSGRCTASFIKVPQAKLPSVVHAGASSEHVXTRRFALSVRSCFDLQNKVSMKWILTLVQFIDSERHYFDPNIYTELVTGVPAIFSHFVTNLPAFHQILVFVCVKSVPVPYVPADERYLIGRIGPRQYRMYRCIVRYGYKDVQKDDENFENHLVMSIAKFIQMEAEEAASSGSYESSNEGRMAVIHTTDATGTGLIMRDSNEGTSLTRSSKSETLQSLQSIYEQESGGLSRRRVRFQIAEEEQINPQVRDELSDLLEAKEAGVAYIIGHSYVKARKNSNFLKSFAIDYAYSFLRKNCRGPSVTLHIPHISLIEVGMIYYV

SEQ ID NO: 8878 - protein, 612 aa, Synechococcus sp.
MQLQTVTIQQRATGAYALIDSLCQHGVKHIFGYPGGAILPIYDELHRAEAAGRVQHILVRHEQGAVHAADAYSRATGEVGVCFATSGPGATNLVTGIATAQMDSIPMVVVTGQVPRTAIGTDAFQETDIYGITLPIVKHSYVVRDPRDMARIVAEAFHIAQSGRPGPVLIDVPKDVGTEEFDYVPVAPGDIRLPGYRPTTRGNPRQIAQAIALVKVARRPLLYVGGGAITAGAHAELRAFAERFQLPVTTTLMGKGAFDERHPLALGMLGMHGTAYANFAVSECDLLIAVGARFDDRVTGKLDEFASKAQVIHVDIDPAEVGKNRVPEVPIVGDVRQVLNELLARAEEQISADDATRTQPWLDRIAYWKREYPLQIPYYADVLSPQQVIHSLGEAAPDAYFTTDVGQHQMWAAQFIKNGPRRWISSAGLGTMGFGMPAAMGAQMALPDDTVICVAGDASILMNIQELGTLAQYNIPIKVVVVNNGWQGMVRQWQEAFYDERYSNSNMERGMPDFVKLAEAFGIKGMRVSHPDELQAAIAEMLAFDGPVFLDAIVKRDENCYPMVPSGHSNAQMLGLPKDPTLDLDLAIATCSSCGAKTLPSHKFCPDCGAKL

SEQ ID NO: 8879 - protein, 342 aa, Pseudomonas aeruginosa
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEAIQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 8880 - protein, 970 aa, Vicia faba
MEKHLKKSPSSSSSSSMRPSFPRDPRGSLEVFNPTSNTSSPVRSPSNLKNWTETEEPRNEFPDKVTNTSWMAIKEGETGAAVQRAAEWGLVLTTDAETGKPQGVAVRHSGGDEPNAVELESKRNSNNTVRTSGESSDGGDPRGFPRVSDDLKDALSAFQQTFVVSDATKPDYPILYASAGFFKMTGYTSKEVIGRNCRFLQGADTDPNDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRAMSESGHRPFIRKSGGGGSSEEDERLENKSRRKSDSVASFRPKPQGKIRHSMERISELPENKQKNSRRGSFMGFMRKSHSIDESIDNEVIVDVSSGSEDDERDDSFEFDDKEKLKEKRKGLDLATTLERIEKNFVITDPRLPDNPIIFASDSFLELTEYSREEILGKNCRFLQGQETDPATVRKIREAIDNQTEVTVQLINYTKSGKKFWNLFHLQPMRDHKGEVQYFIGVQLDGSQHVEPLHNCIAEESAKEGELLVKETAENVGEAVKELPDANQKPDDLWKNHSKVVRPKPHRKDDDAWRAIQNVVGNGEQVGLKHFRPIKPLGSGDTGSVHLVELEGTGHYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQRNGHVSLTDFDLSCLTSCKPQLILPATEEKKKRKNKKKKGQPKNQEVPMFMAEPMRASNSFVGTEEYIAPEIITGSGHTSAVDWWALGILLYEMLYGYTPFRGKTRQKTFGNILHKDLKFPKSKPVSPHGKQLIYWLLHRDPKNRLGSLEGANEIKNHPFFKNVNWALVRCMKPPELDAPILLDNDEKKEAKDIDPGLDDLQKNIF

SEQ ID NO: 8881 - protein, 337 aa, Triticum aestivum
  unsure (1)..(337): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVXEDKYTSDVNIVSNASCTTNCLAPLAKIXNDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 8882 - protein, 284 aa, Zea mays
MARLCCFGAGCSDFTGQGSIASGKGKGCQGQVKICYGYNLVRGMTNHPMEDYHFAELVDVKGNELGLFAIYDGHLGDTVPMYLQKNLFTNILNEEEFWTHTDRAIIKAYEKTDQAILSHTPDLGQGGSTAVTAILVNGRKLWVANVGDSRAVLLKGGEPIQMSIDHDPNVERSVIENRGGFVSNMPGDVPRVCGQLAVSRAFGDRNLKSLLRSEPDIKIEDIDHTAELLVLASDGLWKVMNNQEVVDLAKRYKDPYAAAKQLTVEAQKRDSKDDISCIVVRFKA

SEQ ID NO: 8883 - protein, 495 aa, Oryza sativa
MEEEAAVARLGCDQVLSILHLLPAESVLSFAAACRAFHAWASSDALWEALCRRDWGARATAALAERRRRGGGGVPWRRIYAEVALLGALSARRVPVKGASPRPRASHSLNLVAGWLVLFGGGCEGGKDAKSTYLLTLSSRAYSGLWHEFHMLGRHLDDTWVAYVGNGAGNRSSAVFSWQQLDSGTPSGRFGHSCSIVGDALVLFGGINDQGQRLNDTWIGQIICEESRRMKISWRLLEVGPHAPYPRGAHAACCVDDKFIVIHGGIGQSGSRLGDTWLLDLSNGLRSGIWHQIEDTEPLPLSRSGHTLTWIGGSRMVLFGGRGSEFDVLNDVWLLDINERYPKWKELKYDLSSVLGEMPFPRVGHSATLVLGGKILVYGGEDSQRRRKDDFWTLDLPALLQFESGSKKMTKRMWKKLRIDGQCPNYRSFHGACVDTSGCHVYIFGGMVDGLVHPAEASGLSFHIKLLDNRSEDLPENISTNLYHVDIPPRRYWPL

SEQ ID NO: 8884 - protein, 152 aa, Zea mays
MEYSNLQQQAASLKKNLFDQGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGM

SEQ ID NO: 8885 - protein, 243 aa, Zea mays
  unsure (1)..(243): unsure at all Xaa locations
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSXQQQAPSHVGNGLFFHPLEAAAEPTLQIGFAPEHMNNFMPTWLP

SEQ ID NO: 8886 - protein, 664 aa, Methanosarcina mazei Goe1
MPGNAIKLKNNLKTDKTQGLMLMKRKEFRELVSVEEARKIINSLKVTPEKEYLALENAYGKTLAEDIITEINVPPFPRAVMDGYAVRAEDTYAGSEKVPVKLKLLGNIPAGSDEKFRISAGEAVEIATGAPIPEGADAVVMVEYTYEENETVSVLGAVTAGENIMKAGSDIRKGERVLRRGRKLGTREIGVLASTGKKEVPVLRLPIGIISTGDELVSPGENLTQGKVYDANSYTLYAGVKECGASPLLYGIVKDDENLMEKVLETAISECALILTSGSTSSGSGDVMYRLIDRAGETLAHGVNIKPGKPVVIGVIKSVPIIGLPGNPTSALMIFNEFVAPLLRKSLGAGAGTRKTEKGIMGTDLRSEGRQQLLPVGMVRGRVYPADRGSGAITSLSGADGFIEIPPKTEFIESGTPVEVTLFGEVEKPDLQISGGFCPGLDVLEDLSGLRFRTLYTGSSGGFSAIAAKTADIAGVNLPSKSKGQAEALYNIPIMKNMELSEAVLVRGYRREVGLLVRLDSTIKGLEDLPGKHLINRNRGSGIRALLDLKIEELAGEKEINKKEFTDSIHGYSSGAKSEVAVCEAVLSGKADAGVGLRNCAEKNNDIKFIKIAEEEYDFLIRKEVLDTPEVQKFLQTLGSKEFASKLPAGLQVCERTGEIIYNG

SEQ ID NO: 8887 - protein, 362 aa, Kluyveromyces lactis
MSKNIVVLPGDHVGKEVTDEAIKVLNAIAEVRPEIKFNFQHHLIGGAAIDATGTPLPDEALEASKKADAVLLGAVGGPKWGTGAVRPEQGLLKIRKELGLYANLRPCNFASDSLLDLSPLKPEYAKGTDFVVVRELVGGIYFGERKEDEGDGVAWDSEKYSVPEVQRITRMAAFLALQQNPPLPIWSLDKANVLASSRLWRKTVEETIKTEFPQLTVQHQLIDSAAMILVKSPTKLNGVVITNNMFGDIISDEASVIPGSLGLLPSASLASLPDTNKAFGLYEPCHGSAPDLPANKVNPIATILSAAMMLKLSLDLVEEGRALEEAVRNVLDAGVRTGDLGGSNSTTEVGDAIAKAVKEILA

SEQ ID NO: 8888 - protein, 464 aa, Glycine max
FSNCIQIYPNASSIFFRFTHKQMSVVTDSPVHSSSSDDFIAFLDAELDASSPDSSPDKEVEKQDDDELESVRIKRRKFESIEETEGSTSEGIIKQSLEASMEVDVCTHPGSFGNMCIRCGQKLDGESGVTFGYIHKGLRLHDEEISRLRNTDMKSLLCRKKLYLVLDLDHTLLNSTHLAHLTSEESHLLNQTDSLRDVSKGSLFKLEHMNMMTKLRPFVRPFLKEASEMFEMYIYTMGDRPYALEMAKLLDPQGEYFNAKVISRDDGTQKHQKGLDVVLGQESAVLILDDTEHAWMKHKDNLILMERYHFFGSSCRQFGFNCKSLAELKSDENETDGALAKILKVLKQVHCMFFDKQEDFDDRDVRQMLSLVRREVLSGCVIIFSRIVHGAIPSLRKMAEQMGATCLTEIDPSVTHVVATDAGTEKCRWAVKEKKFVVHPLWIEAANYFWQKQPEENFILKKKQ

SEQ ID NO: 8889 - protein, 322 aa, Brassica oleracea var. acephala
GHASTSTSPVFVQAPSEKGFSSFAIDFLMGGVSAAVSKTAAAPIERVKLLIQNQDEMLKAGRLSEPYKGIGDCFGRTIKDEGFGSLWRGNTANVIRYFPTQALNFVFKDYFKRLFNFKKDRDGYWKWFAGNLGSGGAAGASSLLFVYSLDYARTRLANDSKAAKKGGERQFNGLVDVYKKTLKSDGIAGLYRGFNISCVGIIVYRGLYFGLYDSLKPLLPADLQDSFFASFALGWLITNGAGLASYPIDTVRRRMMMTSGEAVKYKSSMDAFQQILKKEGPKSLFKGAGANILRAIAGAGVLSGYDKLQLLLLGKKYGSESG

SEQ ID NO: 8890 - protein, 75 aa, Glycine max
  unsure (1)..(75): unsure at all Xaa locations
SISWPGDTTVNRAGAGMDAPFTGLKSMAGLPTRXTYNDITSIGCNCXRVQCMQVWPPIGXKKYETLSYLPDLDDA

SEQ ID NO: 8891 - protein, 331 aa, Acinetobacter glutaminasificans
KNNVVIVATGGTIAGAGASSTNSATYSAAKVPVDALIKAVPQVNDLANITGIQALQVASESITDKELLSLARQVNDLVKKPSVNGVVITHGTDTMEETAFFLNLVVHTDKPIVLVGSMRPSTALSADGPLNLYSAVALASSNEAKNKGVMVLMNDSIFAARDVTKGINIHTHAFVSQWGALGTLVEGKPYWFRSSVKKHTNNSEFNIEKIQGDALPGVQIVYGSDNMMPDAYQAFAKAGVKAIIHAGTGNGSMANYLVPEVRKLHDEQGLQIVRSSRVAQGFVLRNAEQPDDKYGWIAAHDLNPQKARLLMALALTKTNDAKEIQNMFWNY

SEQ ID NO: 8892 - protein, 764 aa, Solanum tuberosum
MIEEEKFDLERNFSTISESGSIRVPLLKSKSRVNNTSQIAIVGANVYPIESLDYDIVENDLFKQDWRSRKKVEIFQYIFLKWTLVLLIGLSTGLVGFFNNIGVENIAGFKLLLTSNLMLDGKYFQAFAAFAGCNVFFATCAAALCAFIAPAAAGSGIPEVKAYLNGIDAHSILAPSTLLVKIFGSILGVSAGFVVGKEGPMVHTGACIANLLGQGGSRKYHLTWKWLKYFKNDRDRRDLITCGAAAGVAAAFRAPVGGVLFALEEIASWWRSALLWRTFFTTAIVAMVLRSLIQFCRGGNCGLFGQGGLIMFDVNSGVSNYNTIDVLALIFIGVLGGLLGSLYNYLVDKVLRTYAVINERGPAFKILLVMSVSILTSCCSYGLPWFAGCIPCPVGLEEKCPTIGRSGNYKNFQCPAGHYNDLASLFLNTNDDAIRNLFSSNNSNEFHISTLLIFFAGVYCLGIITYGIAIPSGLFIPVILAGASYGRIFGRALGSLSNLNVGLFSLLGAASFLGGTMRMTVSICVILLELTNNLLMLPLVMLVLLISKTVADIFNKGVYDQIVKMKGLPFLEAHAEPFMRNLVAGDVCSGPLLSFSGVEKVGNIVHALKYTRHNGFPVIDEPPFSETPELCGLVLRSHLLVLLNGKKFTKQRVLSASNILSRFHAFDFAKPGSGKGLKFEDLVITEEEMEMYIDLHPITNTSPYTVVETMSLAKAAILFRQLGLRHLCVVPKKTGRAPIVGILTRHDFMHEHISNLYPHLVPHK

SEQ ID NO: 8893 - protein, 488 aa, Gelidium latifolium
MSNSVEERTRIKNERYESGVIPYAKMGYWDPDYAVKETDVLALFRVTPQLGVDPVEASRAVAGESSTATWTVVWTDLLTACDLYRAKAYKVEEVPNSSDQYFAYVSYDVDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFSYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 8894 - protein, 1104 aa, Micrococcus sp.
MSKKWKQKFLMVLALLLVIGGDAVCSSATGQAETSTAPADREVRLSILVRINDRDWIFGRGHRRRLMIKSILSRMKVGVRVSRHVAVAPRNEGIWICFAQHLKLDYSPKRIWGSLIQVNKDSLTQAFVTSGIEQIRIVPDGSAPVIDNGENAMFYYRDKELFAADAMNTIEKVELQFDGETHEMTYEPENERFVFLANDIPTGEHPYTYLVTKAGVTTEVTDPYNTVDGVSTLVFNQADLAVSGTVAPAAIDFNQNAVLSVDIEGITEDVKISKIVADTSLLGGSAQLEIDPTLKEISIAVDDDIAAGTKAIPLTVTDSYGNLYKGTAEVEVKTRQSVGEGDFDWDESVIYFMLTDRFFDGDASNNDPYDLNYDKESRGTYQGGDFKGITDKLDYLDELGVNTIWISPVVENIKYDVRYYETSEPYYGYHGYWANNFGELNPHFGTMEEFHDLIDGAHDRNMKIMVDVVVNHTGYGLKEIDGSVTNPPAGYPSDADRARFSDLLRQGADVGTDEVVGELAGLPDFITEDPNVRKQIIDWQTDWIEKATTENGNTIDYFRVDTVKHVEDATWMQFKNALTEKMPEFKMIGEAWGAKVDNTLGYLETGTMDSLLDFGFKETARSFVNGSLEAANASLTARNAKLDNTATLGQFLGSHDEEGFLHSLAGDKGKLQVAATLQATAKGQPVIYYGEELGQTGANNYPQYDNRYDFAWDQVEGNEILAHYTKILNFREGYSKVFAKGERTLVGGSDKDQFLLFSRDYQDQKVYVGLNVAEESKAVTLTVDSADAVVTDAYSGTEYTATAGKVNLTLPGKADPGTVLLTVEGGNITGVAKDNGEVVVELVPENNIRIHYKREDNVYKNYGAWLWNDVASPSANWPVGATMFEKTDSYGAYIDVPLADGAKNIGFLVMDITAGDAGKDGGDKGFTISSPQANEIWIKQGSDKVYTYEPVDLPANTVRIHYTREAVDYDDFGIWNWGDVASPSDGWPTGAVNFDGTDRYGAYPDIKLTEAAKEIGFLVVNEKTQEKDAGDKSFNLLDKFNHLWIKQGDDTVYVSPYDEVASGLGSAEVVSENTLLLRFNSTDGFTSEKLVAGLAIQDADSAAL

SEQ ID NO: 8895 - protein, 449 aa, Desulfovibrio desulfuricans G20
MSTNYPVFNCKNGDDVIRAVKDYNVSFVQFWFVDILGNLKSFQVTPDELEAAFEEGMGFDGSSILGFTRIEESDMIAFPDASSFQICSWRPMDRPVARMFCDIRTPDGNPYEGDPRYVLRRLVDKAAQKGYTYYVGPELEFFLFADSTCPRPLDSGGYFDAPPLDLGNEVRRDIIFALQKMGIDVEYSHHEVAPSQHEIDLRYNEALKMADIAMTYKVVVKEIARKHGVYATFMPKPIFGENGSGMHVHQSLFKNGKNAFFDANDPHHLSAEARHYIAGLLTHASEITCITNQWVNSYKRLVPGYEAPVYIAWAQRNRSSLIRVPMYKPGKEAATRIELRNPDPACNPYLAFAAMLGAGLEGIEKGYEVPRAVEENIFAMEAEDLSAKGIDSLPGSLYEAAVALRDSALMKEVLGEHTHQNLVGNKLIEWDAYRTHVSEFELKRYLPVL

SEQ ID NO: 8896 - protein, 470 aa, Xanthomonas campestris pv. campestris str. ATCC 33913
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVNLPHALIAGPHAGGIVNLPAVVITFLVAGMLMAGTKESATLNAVLVVLKIIALGVFVAIALPAFNSANLQPFMPYGFSKAMGPDGVERGVMAAAIIFFAFYGFDAISTAAEETKNPGRDLSIGIVGSMIGCTLIYVLVALSAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPTRARAFRTPLAWVVGPVAILGCLYLFWSLPSTTQGWFLVWNALGVVVYLAYGRRNSRLGKVG

SEQ ID NO: 8897 - protein, 325 aa, Bacillus anthracis str. Ames
MLVISAKEQRDLVNMNEVIAYAALALQEFSAERTITPIRTSLPFANEKNTALIMPSVAEGLEVLGLKVVTVVPHNKKIGKKTINGIVMLSDFQTGEPLALLEGSYLTMIRTGALSGVATKYLARHNAKTLCIIGTGEQAKGIAEAVFAVRDIERVMLYNRTEEKAYAFSQYIQKRFNTPTYVHKNANEAISEADIIVTTTNASTPVFSEKLQKGVHINAVGSFRPNMQELPSHAIANANKVVVESKEAALEETGDLQVPVREGLFEASDIHAELGQIISGEKAGRESDEEITVFKSVGLAVVDIIVAKYLYEKAVERGGGSRIEF

SEQ ID NO: 8898 - protein, 303 aa, Desulfitobacterium hafniense
MNNRSTGEILPHLLKYDSVHGIFPAQIQHTEDGFTVDGQLVKVVSHTDPGDIPWGELGVDIVIESSGKFNNGPACQKHLNNGARKVIISAPAKEEDITLVMGVNEEIYDPQKHHIISNASCTTNCLAPVAKVIHKNFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 8899 - protein, 305 aa, Streptomyces fradiae
MRTTLREILGSGRLSFSHEFFPPRTEAGTRTLWNAIRRIEPLAPTFVSVTYGAGGSSRDRTVEVTKRIATDTTLRPVAHLTAVGHSVAELRRIIGQYADAGVRDVLALRGDPPGDPNAPWVPHPEGLTHAHELVSLVRGSGGFGVGVAAFPERHPRSPDWDSEIRHFVRKCRAGADYAITQMFFRVEDYLRLRDRVAAAGCCTPVIPGIMPATDVRQIARFAELSHATFPEGLARRLEAARGNPAEGHRIGVEYATAMAGRLLAEGAPGLHYITLNRSTATLEIHRNILGTPAPGSARQVLAAPL

SEQ ID NO: 8900 - protein, 382 aa, Daucus carota
MRFTRVYTEVFNMTDHSLLCTETNNLCFDDLEARDDQDPRIDCENVVGNESEALICAVPLQRDEDFVFVFESKVNFCPEVIFSTDRSGELDLCVRKEALDWIYKAHAHYNFGALSVCLAVNYLDRFLSLYELPSGKKWTVQLLAVACLSLAAKMEEVNVPLTVDLQVADPKFVFEAKTIKRMELLVLSTLKWRMQACTPCSFIDYFLRKINNADALPSGSLIDRSIQFILKTMKGIDFLEFRPSEISAAVAICVTREAQTLDINKAMSNIIPVEKDRVFKCIEMIQDLTLVTETSNVASGRTRAQVPQSPVGVLDAACLSYKSDERTVGSCPNSSLHTETSPHTKRRKLIEIMKCGFYSITQFQIFSEWEFWCGCLCKRPPL

SEQ ID NO: 8901 - protein, 492 aa, Gossypium hirsutum
MDPYKHRPSSAFNSPFWTTNSGAPVWNNNSSLTVGPRGQYLLEDYHLVEKLANFDRERIPERVVHARGASAKGFFDVTHDISHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDLGVPQDYRHMEGSGVNTYTLINKAGKAHYVKFHWKPTCGVKCLLEDEAIKVGGANHSHATQDLYDSIAAGNYPEWKLFIQTIDPDHEDKFDFDPLDVTKTWPEDILPLQPVGRLVLNKNIDNFFAENEQLAFCPAIVVPGIYYSDDKLLQTRIFSYSDTQRHRLGQTYLQLPANAPKCAHHNNHHEGFMNFMHRDEEINYFPSRYDPVRHAEMFPIPPAVCTGRREKCIIEKENNFKQPGERYRSWAADRQERFICRWVDALSDPRVTHEIRSIWISYWSQADKSVGQKLASLLNVRPSI

SEQ ID NO: 8902 - protein, 475 aa, Glycine max
  unsure (1)..(475): unsure at all Xaa locations
MGKEQVQVLNALDVAKTQWYHFTAIIIAGMGFFTDAYDLFCISLVTKLLGRIYYHVDGAAKPGSLPPNVSAAVNGVAFVGTLSGQLFFGWLGDKMGRKKVYGMTLALMVIASIASGLSFGHDAKTVMTTLCFFRFWLGFGIGGDYPLSATIMSEYSNKKTRGAFIAAVFAMQGFGILAGGVFAIIIASVFKSKFDSPPYEVDPLGSTVPQADYVWRIILMFGAIPAAMTYYSRSKMPETARYTALVAKNMEKAAADMSKVMNMEIQAEPKKEEEAQAKSYGLFSKEFMSRHGLHLLGTTSTWFLLDIAFYSQNLFQKDIFSAIGWIPPXXXMNALEEVFFIARAQTLIALCSTVPGYWFTVAFIDRIGRFAIQLMGFFFMTIFMFALAIPYDHWTLRENRIGFVVIYSLTFFFANFGPNATTFVVPAEIFPARFRSTCHGISSASGKLGAMVGAFGXXYLAQNQDPSKADAGYPQ

SEQ ID NO: 8903 - protein, 352 aa, Xanthomonas axonopodis pv. citri str. 306
MLPVHRVLRYLGLAVARRTGGGTRMSASKHQVVCFGEALIDMLALPQARPDEARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVEPAPLLWEALALADVVKLSREELEYLAGTLDSDASAVTQKLWQGRASWLLVTDGGGPVHWQTRTDSGQVPAFQVQVRDSTAAGDAFVGGLLYQLATRAASLEQLCGDPAVINEVIRFAAAVGALAVTRKGAFAAMPSIDEVHSLIQEQS

SEQ ID NO: 8904 - protein, 362 aa, Azotobacter vinelandii
MKPCLPVLAPVLLALGLLLSPASHAAESETAPPRPRVTILATGGTIAGAGASAADSATYQAAKVPVEQLLAGVPQLADLAEARGEQVFQLASESFGNEQLLALGRRVAELAENPEVDGIVITHGTDTLEETAYFLTLVERTDKPIVVVGSMRPGTALSADGALNLYNAVAVAGNPQARGKGVLVTLNDEIHSGRDVAKALNIKTEAFKSPWGPLGMVVEGKSYWFRLPAKRHTLDSEFDIRRIDSLPRVDIAYAYGNLDDTAYRAFARAGAKAIVHAGTGNGSVAAPLVPALRALREEGLQIIRSSRADQGGFVLRNAEQPDDRYDWVVAHDLNPQKARILAMVALTRTQDSKELQRIFWEY

SEQ ID NO: 8905 - protein, 462 aa, Cytophaga hutchinsonii
METAVLDTIEAAVPAIDSIKAVAAITVDTLASKSSLAATDAAVSQLGLTANNIWMMLCTALVFIMNLGFATVESGLARSKNTTNILFKNTITPAIGIIIFCLWGFNLMYPGGAYEGGFFGFGGFGLTAPAAESGGLDLTYAGGYTYWTDFLFQAMFAATAATIVSGAVAERIKLTSYIIFTCIIIGVIYPVVGMWNWGGGWLKSLGFYDFAGSTMVHSLGGWAALAGVIVLGPRIGKYVDGKINPIPGHSLPLATIGVFLLWLGWFGFNGGSVLSADPALTSLVLVTTSLAAAAGAIGALLASVIYLKTLDLSMVLNGILGGLVGITAGADLMSPNDAILIGLISGAAVVFAVIFFDKIKVDDPVGATSVHLVCGILGTLFVGIFGDKGFGGSAEGAGMSQLIKQLIGVGAAASLVFPASYVIFTIISKTVGLRVAAKEEIEGLDIAEHGMKAYNIDVDKEY

SEQ ID NO: 8906 - protein, 212 aa, Photobacterium profundum
MAQAHIVLLDNFDSFTYNLVDQFRSLGHPVTIYRNSLSVEQMEQALADKVNPVLVLSPGPGAPADAGCMPALIKRIKGEVPIIGICLGHQAIVEAYGGKVEGAGEIVHGKSAMMSHTKHNVFGDLPNPLSIARYHSLVATEVPETLDIVADVDGLVMAVINDADRVCGFQFHPESILTTQGAQLLTNTLNWVMSKVESDIETTKTPQTNDKD

SEQ ID NO: 8907 - protein, 101 aa, Triticum aestivum
MSRVSADEDKNPAGDGGGADINLKVKGEDGNEVFFRIKRSTQLKKLMNAYCDRQSVDLNSIAFLFDGRRLRGEQTPDELEMEEGDGIDAMLHQTGGGFPRP

SEQ ID NO: 8908 - protein, 359 aa, Magnetococcus sp. MC-1
MAKKFLVLPGDGIGQEITAEAVKVLNWAIQNGADITLEEGLIGGTAYDATGTPLPAETITQAKAAQAVLLGAVGGTKWEPLDISVRPEKGLLGIRKALDLYCNLRPAAVYPQLADASTLKKEVVAGIDIMVVRELSSGIYFGQPRGVEDLGDGRKKGFNTLVYTTDEIERIARKAFEAARKRSNRVCSVDKANVLESTELWREVVSDLHKREYADVELSHMYVDNAAMQLIRNPRQFDVIVTTNMFGDILSDAASMLTGSIGMLPSASLGDQFALYEPIHGSAPDIAGKGIANPLATILSVAMMLRYSLELPQLADGVEAAVVTVLDQGLRTADIMQPGMTQVGTAQMGDAVLAALNNA

SEQ ID NO: 8909 - protein, 180 aa, Triticum aestivum
  unsure (1)..(180): unsure at all Xaa locations
MAPTVMASSATSVAPFQGLKSTAGLPVSRRSNGASLGSVSNGGRIRCMQVWPIXEGIKNSETLSYLPPLSTXGLLKQVDYLDPSKWVPCLRXSKVXSSSVEHNASPGXYYDGRYWXTMWXLPISGXXGPTQVINEVXKRSRRXPDAYSAXRFDNMRKCMRNSSPTTGSRIRKANSHHTGN

SEQ ID NO: 8910 - protein, 2117 aa, Aspergillus fumigatus
MPNGRSNSPFPRSAGLERSASQGHNQPRQGSSNNLYSSTFSWNSPDISHTDQRRGVGRKAMATSGADDPGPPPTSSSSSKQLQLNPNQIDYFHQNPNASWSSSPKIAPMDSSGTFSHDFSEQEASPASATFRPSTGRTFASEPVDFDYNRDDRRPSVASATTISSQGSKSSTGGRFRKKLQGFFGDEYLPPGESKQEQEQDTRSLSSRPASIDHFKARERANSDGARNFPERSQDDTSSLHPSRPRTPLPSSEITPWLYQSFNDIPQFGEAPIREVPIAPEGSRLAGQTATNSGAPREARRHHGSHRHSRSKEEKPTVAGDLAGYPARPATGRDDSYLGLRPFRDHSLNASTAMSSTTTLGGRSTSPTPSIQSAYSREQSQNSPGAPSNKRSILDKIRRTKAHGPLKHFPGSKSAQEASKSSSKLARREASPRRGRQGSLEGGTSLRNLDLGDYERRKDGKGIVMGSTKLRNRRGLGNEAPPGKDVKLSEEPGVWRLDTDLSHMEGIVSQQPPPSPGDKSKAQDGVPPKHEEGKKSEGLPPGHWDAPESWQVKKHGEDLAARLPNVASDATGIAREPDGTSYFIRVFRIDSTFATLSAGLNATVADILLMLGRKSFLQDHLNNYEIVMKRNDLSRQLDHSERPILMQKRLLEQVGYTAKDRIEEIGREDHSYICRFIFLPTKLSGYSSLDGDPGFSRMQKFSHVDLQGRSLVTIPITLYKKASEIISLNLSRNLSLDVPKDFIQGCINLREIKFIGNEARRLPASFSLASRLTYLDVSNNLLEELGHANLDRLHGLVSIKMANNKLSELPSYFGNFQYLRSLNISSNNFQVFPSFLCNLKSLVDLDISFNNIAELPNIGKLVTLERLWMTNNMLSGPLDETFKDLVNLREIDARFNAITNIDILAQLPRLEQLLIGHNAVSKFKGSFPKLRTLLLDHCPMTQFDIDAPVPTLTSLNIASAKLVQFRDSLFENLPNLTKLILDKNHFVSMSPHIGKLRRLEHFSMIKNPLAALPATIGCLTELKYLNLRECNLRRLPAEIWHCARLETLNVSSNVLDSFPKHGSSPPQPPTDTGITPAATPGGATTPSYEELGPLQEQDGLETRRPSQTSGGFISSGGSPNDGTYRKPSVASSLGQSGRKVSAASRSGTEGSPSSRKDSNFSQHVASTFAGSLRNLYLADNRLEDDIFRELSLIPELRVVNLSYNELTELPQGLLKRWPFLTELYLSGNELTSLPSDDLEEGSNLKVLNLNANRFQVLPAELCKVSKLAILDVGSNALKYNVSNWPYDWNWNWNRNLKYLNFSGNKRLEIKPNITSAGTTTANGTDLTDFNSLTHLRVLGLMDVTLTTPTIPEENEDRRVRTSASLAGSLAYGMADFLGKSEHLSIIDMIVPRLKPDNVETLVGLFDGQAQSTGGSRIAKFLHENFTSTFSSELKRLRVEEEETPLDALRRTFLALNKNMAAAAYKSIDDRSVRQFHRGSPATKLLNQDDIRSGGVATVLYLNNMDLYVANVGDAQAILVKSDGTLKYLTKNHDPAEPHERARIRAAGGFVSRNGRLNDILHVSRAFGHFQLMPAVVAAPHTMHVQLTEQDEMIILASKELWDYVTPDVVVDVTRAERRDLMIAAQKIRDLAISFGANNKLMVMILGVSDLKKREKFKFRGTSLSMGPPAFPEEQIIPSTKRTKKPRDMPGDSRLARFDYVDAPIGELAIIFTDIKKSTSLWETCPDAMRSAIQIHNDILRRQLGIIGGYEVKTEGDAFMVAFSTTTAALLWCFNCQTQLLEAEWPTEILEQPQCQVQYDMENNIIFRGLSVRMGIHWGEPVCEKDPVTNRMDYFGPMVNRASRISAVADGGQIFVSSDFMSDIQRNLEVYADSERAASTGSEESYAVDSLGYNIRRELQQLNSQGFVIKDQGERKLKGLENPEPLYLIYPHSLSGRLTTLEQAEARENGPTTISKHSELEIQADLIWRLWELTLRLERLCGALENPGEARLKEPNVALFNLVKNHGGELADSTVVSLVEQQVTRIEMNVTTLSVRYMLKPFKPGDKLSDHAVPIGVVMQQLQTQLAEYRALKEQLAVGGAGITGVSSSSPGAEGQDTGESDPSSASSSFLQLATSSE

SEQ ID NO: 8911 - protein, 96 aa, Cucumis sativus
MSSSEIGGYVPCKDPNDPHVKDIAEWAVAEYNKSQGHHLTLVSILKCESQVVAGVNWRLVLKCKDENNGEGNYETVVWEKIWENFRQLITFDHLLT

SEQ ID NO: 8912 - protein, 511 aa, Cylindrotheca fusiformis
MAEFDNTFILDFCSGGNESSSDVQALCQVAGLANGTSASAAGLVEGINTFFLLFAGALVFLMQAGFAMLCAGSVRQKNVKNIMLKNMLDACGGAIGFWTIGYAFAYADNSSGDKTFIGGKNFFVNQLDESGGAWIGFFFQFAFAATAATIVAGTVAERCKMSAYLCYSVFLTGFVYPVVVHSIWSADGWLTAFRDDPWKGVGVIDFAGSGVVHMTGGATALVAAIVLGPRKGRFYDEDGNALETPASFPAHSVALQVLGTFLLWFGWYGFNPGSALVIDNAASASTSALCAVTTTLAAASGCVCAMFTDTIIEMMATGEASYDLTMAMNGALGGLVAITAGCSVVTPWASIIIGIIAGWVYIAFSKLLVKLKIDDAVDAVPVHFANGMWGVLAVGFFAEPDAMVTAGYNDVPGVFYKGDGKLLLCQFVAIIWICAWIFFLMTPFFVVLNILGMFRVDPLEEEVGLDISHHRGAAYDMTSAKKEDVEELMEHRSSKHGKVEVPKEVQKEDTA

SEQ ID NO: 8913 - protein, 450 aa, Agrobacterium tumefaciens str. C58
MNTSQDITVAAGGLDATAAIQQAIDAVSSAGGGRVSLSAGRHVSAGLHLKSGVELHLAEDAVLAPVSDYDAYALTRVSVIAEDSDRGMIIANGASNIAVTGPGRIEAGGENFIIGDDAAMGTYVPAKKRPRVMVLEACRNVRLENLNVSASPMWTLHMVNCEDLHFRNLRIENDRRLPNTDGIVLDACRRALIEDCFISTADDGICLKTSAGPDGKAVGVCADITVRGCTVSSMSCALKLGTESFGDFTNVVFEDCKVVQSNRGIGLFSRDGGAMRNIRFSRIETECHETPGGFWGSGEAVTVTVVDRRPERQAGRVENLVVEDLGGSMEGAINLVSTSKAGIHNVRLERITLAQQPGKLGTGLQYDLRPTNADIAPSAEAAGRANAWTQDAEGRIVGMEDYPGGMPAIYLSGVHRFSADNVAIKRAMPLPEGWNIKEIVATTGSDEGSM

SEQ ID NO: 8914 - protein, 216 aa, Oryza sativa
  unsure (1)..(216): unsure at all Xaa locations
EDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHXWPISXCTAEGLKAALLLSKISPDIVGEAVEVNRLYDSVNCLMSYM

SEQ ID NO: 8915 - protein, 408 aa, Oryza sativa (japonica cultivar-group)
MSIQANPLIKTLALSPRRRMAPPAPATARRPMAAVRCSAAKRSYNVTLLPGDGIGPEVVAVAKDVLSLAGALEGVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 8916 - protein, 332 aa, Saccharomyces cerevisiae
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 8917 - protein, 462 aa, ASPERGILLUS NIDULANS FGSC A4
MKLASTLAGLLLPLISTVSAADVDAWKSRNIYFALTDRVARGSDDTGGDACDDLSTYCGGTFKGLEGKLDYIKGMGFDAIWITPVVANHDGGYHGYWAKDLYSINENYGTADDLKSLVSAAHEKGIYIMADVVANHMGSPISDNQPESLSQESAYHSACTIDYSSQESIETCRIADDLPDVNTESEEIRTLFKEWITWLVKEYEFDGLRIDTVKHVEKDFWSDFSSAAGVYTIGEVFDGDPDYLAGYANTMDGLLNYAVYYPVNNFYQQAGSAQDIVDMHDKIDSSFPDPSALGTFIDNHDNARWLSNKDDKSLLKNALAYVILARGIPIVYYGTEQGYAGGNDPENREDLWRSNFDTDADLYKAISLLSAARSAAGGLGDNDHVHLHVAESAYAWSRAEGKLVVVTSNSGSGSENEICFDSKTPNGSWENIFGEGTISADDSGQICVSITNGEPAVLVAQS

SEQ ID NO: 8918 - protein, 127 aa, Desulfitobacterium hafniense
QLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIW

SEQ ID NO: 8919 - protein, 88 aa, Zea mays
  unsure (1)..(88): unsure at all Xaa locations
VLPRPVNLDLVVLXKLATGFRLNLKGRXRFPSFHRWAPTLSSFTKAPLVPPAHTXVVTVLANQRAMLKTIIRACVGLAPETNMILKYK

SEQ ID NO: 8920 - protein, 183 aa, Triticum aestivum
  unsure (1)..(183): unsure at all Xaa locations
MSDEAASPPGGGGGGGGGGSDDGGGGGGFGGVREQDRFLPIANISRIMKKAIPANGKIAKDAKETVQECVSEFISFITSEASDKCQREKRKXTINGDDLLWAMATLGFEEYIEPLKVYLQKYRETEGDSKLAGKSGDVSVKKDALGPHGGASGTSAQGMGQQVAYNPGMVYMQPQYHNGDMSN

SEQ ID NO: 8921 - protein, 730 aa, Thermoanaerobacter brockii
MSYGIGQITRLGGASNLSPRETVRIANQIQKFLIENTRLGIPALIHEESCSGYMAKGATIFPQTIGVASTWNNEIVEKMASVIREQMKAVGARQALAPLLDITRDPRWGRTEETFGEDPYLVMRMGVSYIRGLQTESLKEGIVATGKHFVGYGNSEGGMNWAPAHIPERELREVFLYPFEAAVKEAKLSSIMPGYHELDGVPCHKSKKLLNDILRKDWGFEGIVVSDYFAISQLYEYHHVTSDKKGAAKLALEAGVDVELPSTDYYGLPLRELIESGEIDIDFVNEAVKRVLKIKFELGLFENPYINEEKAVEIFDTNEQRELAYKIAQESIVLLKNENNLLPLKKDLKSIAVIGPNADSIRNMIGDYAYPCHIESLLEMRETDNVFNTPLPESLEAKDIYVPIVTVLQGIKAKVSSNTEVLYAKGCDVLNNSKDGFKEAVEIAKQADVAVVVVGDKSGLTDGCTSGESRDRADLNLPGVQEELIKAIYETGTPVIVVLINGRPMSISWIAEKIPAIIEAWLPGEEGGRAVADVIFGDYNPGGKLPISIPQSVGQLPVYYYHKPSGGRSHWKGDYVELSTKPLYPFGYGLSYTEFSYTNLNISNRKVSLRDRMVEISVDIKNTGTLKGDEVVQLYIHQEALSVTRPVKELKGFKRITLDAGEEKTVIFKLSIEQLGFYDENMEYVVEPGRVDVMIGSSSEDIRLRDYFEIVGEKEKVAKKFITEVRVENK

SEQ ID NO: 8922 - protein, 54 aa, Triticum aestivum
GLAYRYVGDVLGDAQVYADHADKPQLDADDVRLAIQANANFFFFQPPTRKVLLE

SEQ ID NO: 8923 - protein, 101 aa, Zea mays
MSGVTADEDKKPAGDGGGAHINLKVKGQDGNEVFFRIKRSTQLKKLMNAYCDRQSVDLNSIAFLFDGRRLRGEQTPDELEMEEGDEIDAMLHQTGGCFPGP

SEQ ID NO: 8924 - protein, 231 aa, Zea mays
MAASRRSSVELPVADPAADPDQVRLHQLGYKQELKRGLSVLSNFALSFSIISVLMGVTITYNTGLRYGGPVSMTLGWFLVSALNACVALSMAEICSAYPTSGGLYYWSAKLAGKDWAPLASWLTGWFNIVGQWAGTTSVDFSLAQLVQVIVLLATGGLNGGGYMASKYVVLAIYGAILVIHGLMNSLPIQYLAWFGHLGAFWNTAGTFALVIIIPAVATERASTEFIFTHL

SEQ ID NO: 8925 - protein, 179 aa, Actinobacillus pleuropneumoniae serovar 1 str. 4074
MNQLDLIKSSIKSIPDYPKAGIIFRDITSLLEVPEAFKATVDAIVAEFKDKGITKVVGTESRGFIFGAPVALALGVPFVLVRKPKKLPRAVISQSYALEYGEDTLEIHLDSVKENDNVLMVDDLLATGGTIDATAKLIRRLGGKVEHAAFVIWLPDLGGKERLEKEGINSFTLVEFAGH

SEQ ID NO: 8926 - protein, 452 aa, Oryza sativa
  unsure (1)..(452): unsure at all Xaa locations
MAAQDDLYVSLVCHAPSDHRAAQNARISRSEQPARRSNSRLCDVRLSRPGARAAPRVLRQVATPLAGRVTASNKPRHPIDRPRARVPSPVPTAPQQASRSRPARVRARAPARARHLALLPLSVMALEAVVFPQGHFGYGCGRDSPAYGMPWCDVLAAAGGGGGFGEFYGVDEWDDQLQVASVDEWEVASKDNSDASTEGKAAAAERAEPVAAGRRKRRRTKVVKNKEEIECQRMTHIAVERNRRRQMNEYLAVLRSLMPASYSQRGHQASIVGGAINYVKELEQLLQSLEVQKSLKNRSGAMDAAGXSPFAGFFSFPQYSTSPRTGCSAAASAGSSGSASSVVMDDTAGSAENGRQSAGIADIEVTMVEGHASLKVLARRRPKQLLKLVVGLQQLRIPPLHLNVTTVDAMVLYSFSLKVEDDSKLGSVEDIATAVHQILGSIQQQEAVLSIS

SEQ ID NO: 8927 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 8928 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 8929 - protein, 161 aa, Oryza sativa (indica cultivar-group)
MEELEGHRGEGRLPPPPPLLPFPKVSVQVYTVPSSSTAASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 8930 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 8931 - protein, 222 aa, Triticum aestivum
  unsure (1)..(222): unsure at all Xaa locations
MSEVFEGYERQYCEESASLSRKCTVASALDGEKKKQRLSEIQSGVQEAESLIRRMDLEARNTPPSVKAGLLAKLREYKSDLNNLKSELKRISAPNARQTTKEELLESGMADTLAVSTDQRGRLMMTTERLNQSTDRIKESRRTMLETEELGVSILQDLHQQRQSLLHAHDTLHGVDDNVGKSKKILSAMSKRMDRNKWIIGGIISAXLVVAILIILYFKLAH

SEQ ID NO: 8932 - protein, 396 aa, Glomus intraradices
VTVVGIIMFWRVVMGVGIGGDYPLSAIITSEFATKKRRGAMMASVFAMQGFGILGSAIVALIVLAAFRSAIIADVSAVDYCWRIVLGCGAIPGIAALYFRLTIPETPRYTMDVEHDVNKATSDVANYLQKTDTTDENDGPGNHVGVPKASWSDFTSYFGKWKNGKVLLGTSMSWFALDIAFYGIGLNNGIILSAIGYADTHDADFNLRAYNSLKNMALGNIIITIMGTVPGYWVTVAFVDKWGRKPIQIMGFAVLTVLFIVMGAAFNPLKEHSIPAFIVLFTLLQFFQNFGPNTTTFIVPGEVFPTRYRSTGHGISAASGKLGAIVAQVGFSKLKDIGGPNAFVGQLLLIFAAWMFIGGLFSILIPETKGLSLEELANEDHDFNVEERKERVKAEA

SEQ ID NO: 8933 - protein, 123 aa, Triticum aestivum
MISSRKLAQLSKKWQGIGAIGRRRFATSDKDIHPSCSSVAGKGHFVVYSSDGRRFEIPLVCLRTTVFEELLRMSQEEFGFTSDGGITLPCDTTMVEYVMCLLRREASQDVERALLSSIVTTCH

SEQ ID NO: 8934 - protein, 356 aa, Zea mays
MRRVALLLVAAVCALAAPAAAVVTDGLLPNGNFEDGPPKSALVNGTVVSGAHAIPRWETSGFVEYIESGHKQGDMLLVVPLGAHAVRLGNEASIRQRLAVARGAYYAITFSAARTCAQAERLNVSVSPEWGVLPMQTIYGSNGWDSYAWAFKAKMDAVTLVIHNPGVEEDPACGPLIDGVAIRALYPPALARRAGGNNLLKNGGFEEGPYFLPGASWGVLVPPNIEDDHSPLPAWMIVSSKAVKYVDAAHFAVPQGARAVELVGVGESALVRAVSMAPEANSARAIVKVPYRARGTGGYKRAVLDFTAIANRTRVVFQSTFYHMKPDGTLCGPLVDDASLVGLRKKKPARRLMQLL

SEQ ID NO: 8935 - protein, 196 aa, Mitthyridium sp. Mishler 11-12/1998
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFTTDSHSSIFDAKAGIALSDTFVKL

SEQ ID NO: 8936 - protein, 178 aa, Oryza sativa
  unsure (1)..(178): unsure at all Xaa locations
MSGRRSFFASKKPSRSSNPFDSDSDDGGREQRPARASSVPPPADQRGSLFGGGDGFSASSAAARSRYRNDFRDTGGVEAQSVQELEGYAAYKAEETTQRVQGCVRIAEEMRDTASKSLVTIHQQGQQITRTHMMTLDIDQDLSKXEKLLGVIFGGHIFPKQWKPKRELGEIKGGLLLT

SEQ ID NO: 8937 - protein, 361 aa, Emericella nidulans
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKSKYLAPIDSISYATIN

SEQ ID NO: 8938 - protein, 355 aa, Arabidopsis halleri subsp. halleri
ISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLGFYSEEAKLVSEAADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 8939 - protein, 404 aa, Photobacterium profundum
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 8940 - protein, 711 aa, Pseudomonas putida
MPSKKTDAPKQSEAAGTQTPDRANTNAKLQSLETFRSDATGQALRTNQGVKIADNQNSLKAGARGPSLLEDFIMREKITHFDHERIPERIVHARGTGAHGYFQSYGNHADLTKAGFLQDPDKITPVFVRFSTVQGPRGSGDTVRDVRGFAVKFYTDEGNFDLVGNNMPVFFIQDAIKFPDFVHAVKPEPHNEIPTGGSAHDTFWDFVSLVPESAHMVMWAMSDRAIPRSLRMMEGFGVHTFRLINAEGVASFVKFHWKPRQGVHSLLWDEAQKLAGKDTDFQRRDLWEAIENGDYPEWELGVQIVPEADEHKFDFDLLDPTKIIPEELVPVTPLGKMVLNRNPDNFFAEVEQVAFCPGHIVPGIDFTNDPLLQGRLFSYTDTQISRLGGPNFHQIPINRPVAPNHNNQRDALHQHVVHKGRASYEPNSIDGGWPKETPAAAQDGGFESYQERIDAHKIRQRSESFGDHFSQARLFFQSMSPTEQQHIIKAYSFELGKVEREHIRAREVNEILANIDLKLAAAVAANLGLPAPKAGTVQVKGSQLAQSPALSQMNHPGSVGIKGRKIAVLVANGVDAASVDKLIKALEAHSARPMLLGPTSAPVKATDGKQLPVEASMEGMPSIMFDGIVVPSGKASTDALAASGLAKHFLLEGYKHLKAMVLTKELATGLGLKEDKGLLLADDQKAVDAFVKAVEGHRVWEREAAAEAVPA

SEQ ID NO: 8941 - protein, 366 aa, Chloroflexus aurantiacus
MPIRKKAFLQALSPTPPPRRSSTGVVVARLSANENPLGPSPRAMAAVQEALSTIHRYPDASGVALKEALAARVDLHPDQVMLGNGSDELIMLICHAMLGEGDEAVLAQGSFISYARRIQAQGAIARQVPLREMTHDLPAMAAAITPQTRLIFVCNPNNPTGTTVGAAELMAFLEQVPPDVLVVVDEAYLEFVTRPDFPDLLPLLRDGRDNLLIVRTFAKIHGLAGLRLGYAFGNADLIAYLERARPVFNVNVLAQIAGLAALDDVDHLERSLAHAAASRAFLTDHLRAMGMTVIPGETNFVVAAIADDTAVAAELARRGVLVTPLSGWGLPGWMRISFGTAEENRVFIEVLRNLMSKGTVATATIS

SEQ ID NO: 8942 - protein, 496 aa, Zea mays
MTMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 8943 - protein, 1011 aa, Arabidopsis thaliana
MDPSSINSSRRKRIGGAVVAAGSVWETRMQSDDEVCNNAIVLHVTNEDKTSSTKQMTLKDETLLGVNGKRRTWKSRASDVKNPSTLEIVRANSLKVTKPRSIGTPPMTPRRSLSSSDSNDKSPSVSVVAKKARSESVEGIEKKTTPGRVKKIRSEVCTTIVKAGEFDSVALRKVNSLPSPNSEKSDTKTEQEVTIIENSKIPEEVKEFGVCQEMIVSAKSNENEQIDNGDQEIGDQDDYEEDGDEEEEREVEKKSVDVKEINVAKENRVGGVEIKKFSQFQNRTSPSPSSVRKISPPVIKRATSVYSAPPNSTSSTDRFAEQEDNFTHSQSKLQSLVDLVMWRDVSRSTLVFGFGTFLIISSSYANDLNFSFISVVAYMGLIYLGLMFVLKSLIHRGMVEEERHKVVGVREEDVKRMLRLIMPYLNESLHQLRALFSGDPSTTLKMGVVLFVLARCGSSITLWNLAKFGFLGAFTIPKIFISYSTHFSAYGNFWMRRFRDAWESCNHKKAVALALFTLVWNLSSVTARVWAAFMLLVAFRYYQHKMIWTTDQADDDEDDNEEEEAEEEKEQMSVASDSPVHSSSSSDDLAAFLDAELDSASDASSGPSEEEEAEDDVESGLKRQKLEHLEEASSSKGECEHPGSFGNMCFVCGQKLEETGVSFRYIHKEMRLNEDEISRLRDSDSRFLQRQRKLYLVLDLDHTLLNTTILRDLKPEEEYLKSHTHSLQDGCNVSGGSLFLLEFMQMMTKLRPFVHSFLKEASEMFVMYIYTMGDRNYARQMAKLLDPKGEYFGDRVISRDDGTVRHEKSLDVVLGQESAVLILDDTENAWPKHKDNLIVIERYHFFSSSCRQFDHRYKSLSELKSDESEPDGALATVLKVLKQAHALFFENVDEGISNRDVRLMLKQVRKEILKGCKIVFSRVFPTKAKPEDHPLWKMAEELGATCATEVDASVTHVVAMDVGTEKARWAVREKKYVVHRGWIDAANYLWMKQPEENFGLEQLKKQLTEEE

SEQ ID NO: 8944 - protein, 470 aa, Synechococcus sp.
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIRQNEEFRFRFQCFPGLLRQLPARSLPQNLTQAQRDYFGAHTYERTDRSGSFHAQWF

SEQ ID NO: 8945 - protein, 261 aa, Hordeum vulgare
TPAPLKRHDSLFGDAEKVSDSKHHGSQVSWMRTLSLAFQSVGIIYGDIGTSPLYVYSSTFPDGIRNRDDLLGVLSLILYTLIIIPMLKYVFIVLYANDNGDGGTFALYSLISRYAKIRLIPDQQAEDAAVSNYHIEAPNSQLKRAQWLKQKLESSKAAKIVLFTLTILGTSMVIGDGTLTPAISVLSAVSGIREKAPSLTQTQVVLISVAILFMLFSVQRFGTDKVGYTFAPVISVWFLLIASIGMYNLVVHDIGVLRAFN

SEQ ID NO: 8946 - protein, 325 aa, Nostoc sp. PCC 7120
MSNPRVLCLGEVLFDCLADQLGLKLEQVKSWTAYPGGAPANVACALVKLGTPAGFIGAVGEDEPGNVLVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSEHGIHNLNDAETAKRIITYASAVGALTTTKAGAIASQPTAMEVETFLASNKI
